United States Patent 10,233,495 (METHODS AND COMPOSITIONS FOR SCREENING AND TREATING DEVELOPMENTAL DISORDERS) - sequence listing, part 40

SEQ ID NO: 457 - DNA, 4997716 bp, Homo sapiens (residues 1,665,907-3,331,812 of 4,997,716)
attttagagtttaacctaatcatcatagcttttgaatgcaggaccgtcctgcttaagctattattcttagtctatcaaacactggaaaaggaaccttttttttttttttttttttgagatggattcttgctgtgtctctcaggctggagtgcagtggcaagatctcagctcacagcaatgtctgcctcctgagttcaagcaattctcatgactcagcctctcaagtaggtaatacaggcgtatgccaccacacctggctaattttggtagagacaaggtttcaccatgttggccaggctggtctcgaactcctgaactcaagtggtgtgcctgcctcagcctcccaaagtgctgggattacaggcttgagccaccatgccctgctggaacatttttatttgtttacctggattgtgctggggacttatgtatattcccttttcatgtgatattttgctatgcaaatttgttttgccactcctggacatgttttattttcatcttcatttcatgtcaataagagtatgtaaatatgacaaaaacaactgaaatgtacaatgtttctatatagtcctcataacaccaggtgtctttctttctcatttcactttcctagaaagtaaaagtcgtctgatttcacatcccaatgcacagagacagaaataaaacatttgtatgtctaaatgagaaaaatttaagaaggaacacaatagaaattagaaaataataaactaaaaaaccaaatataccaaaacttatacaatgaagtgaaagcagggctaagtgagaaatttacagacataaaagcttataaagaagagagttcaaatcaacaactgatatagttttgttctgtgtccccaccccaatctcatcttgtagctctcatagttcccacatgttgtgggagggacctggtgggagataatcaaattataggggcaggtctttcccatgctgttctcatgatagtgaatgggtctcccaaatctgatagttttaaatgagtctcacaagatctgatctgatagatgaatcggtctcacaagatctgatagttttaaatgggtctcacaagatgtgatctgatagtgaacaggtctcataggatctgacagttttaaaaatgggagtttctctgcacaatctctctctttgcttgctgccatccatgtaagatgtgacttgctcctccttgccttccaccatgtttgtgaggcctctctagccatgtggaactgtaagtccaataaacctctttcttttgtaaatttcccagtctcaagtatgtctttatcaggagcatgaaaacagactaatacaacaaccttattgtacaccttaagtaactaaaaaaagaagcgcaaataaataaataaacccctaatctagcagaaggaaggaaacaataaagctggagcaaagataaataaaatagagaatagaagagcaattataaaaaaaatcactaaaactagggttgatgttttgaaaagtacagcaaaatcaacaaacccttactagattattttttaaaaaagagtatactcatataacaaaatcaagaatataagaggagacactacagctgatgccacagaaataaaaggtcataaaactatgaaaattatgcttcagcaaattgtataacctagaaaaaaattgatgaattcctagaaacatacaacttaccaagactgaatcataaagaaataaaaatttgcaatagacctataagggattgaataaataattaaaaatccctgaaaaaagaaaagccctgggccagatggcttcactagagaattctatcaaaacttcaaaaaattaacaggatctttctcaaactattccataagattgaagaggagggaacacttccaaactaatttatgaatcttgcattaacctgacataaaattcagtgaaggacatgatatgaaaactactacaaaccaatatctctgatgaatattgatgcaaaaaccttcagcataatacttgcaaaccaaatttaacagcacattaaaacgattatataacatggctacatgtgatttattcctggaatataagaatggttcaacacagaaataaatcaatgtagtaacctacatgaacagaatgaagggaggaaaaaccatgatcacctcagttgatgctgaaaaaccatttgataaaattcaatatcctttcatgattaaaaaaaaaacactcaacaaactaggactagaaggacattaactcaacatgataagggctattatatgaaaatcccacagtaaacatcatgctcaactgtgaaaaattacacgtttttattctaagttcaggaaaaaggcaagaatgtgctcttacaactagtatttcaaatcctggccagagtatttaggcaacaaaaataaataacaagcatccaaattataaaggaaaaagtgaaatgatctctgttggcagatgacatattcttatatgtagaaaaacctaaagattacacacacacacacacacacacacacacacacacacagagagagagagagagagagagagagagggagacagagagaaaagagagagataacttataaatgaattgagcaaagttgcagtatacaaaatcaataaacaaaaatcagcggcatttctatatactaacagtggataatcttaataggaaattaagaaaatactctaatttacaatagcatcaaaaaacataaaatatttaggaataaacttaacctaggatgtgaaagacatggacactagaaactaccaaatactactgaaaaaattaaagatgacaaaaataaatgggaagacatttacttgtatccatcatgggttggaagacttaatattgttaaaatctgcatgctctccaaagtgttatacagattcaatgcaatctctatcaaaatcacagaggcatttttaacagacatagaaaaaatatatcctaaacgtcatggtctctgggttgctgaaacaatcttgataaagaaaaacaaagcaagaggtctcatatttcctaattttgaaacatattatgatgctacaataattaaggcagcatggcacttgaataaaaacagacatatagactaatggaattagtttattagtgaatgagcttctctagtgcttttcttcttctaggatatattcattcaggttcatgtggttgtgcttccctgggcactcaagattcgattaatatggtcaaggccctttctttcattaatttattttatttttggagacagagtcttgctctgtcacccaggctggagtgcagtggcacaatctcggctcactgtaacctctacctctcgggttcaagctattctcatgcctcagccttccaagtgctgggattacagacatgccccaccacacctggctaattttgtgtgtgtgtgtgtgtgtgtttgtgtgtgtgtgtttgtgtgtgtgtgtgtgtgtgtgtgtgtgtgttttaatagagacggggtttcaccatgttggccaagctggtctggaactcttgagctcaagtgatccgcccgcctagcctcccaaagtgctgggattacaggtgtgagctacccgacccagtccattattttgttactggagaaatatagcacttctcaggctttaccaatacccctaagaggaatttcattattttttttcaggtgcatgtgggtgtggaaattttaatatcaaaataatgttatttccttagtatcacatcactcacaaggtatttatcacatcaagttattccgtaagtgtaggctcatcaaatcctgatgattttggaactcttttcccaaggagggccttgcttctttgttgccaaaataataaatgcccctgacccttgctcttgcccctagagttttgtgtgaaggagtatttgctcccagtggtgaccccctcatctcctgacccagatcctaggtaccaaaagtctcaacacccctagaaggctgattgcaaaggtttgttttgtctaagtaggtaaaggaattatcctattgtgattattttatctttagtagttaaataattttaactttgccaagtacagcttttattcttcaactgttttgctatcttcaactcttttaaactatggaacagttttatgcttgaaatttctgagctaggcacaaaagactcaaaggtaatgtttctcttcagaggctcatattacagaaaatggtgaccctcagttgttcaccagttcagcgtgatctgttaaagttctttgctcctctgtctatgtgaaactttgatcgtgcagggcagtgagctcccatgctatcatgttaaacagtcatagccatctttcctttactgattgatttgtgattcttcattttaaatttaaacctcaacaacaaatgaatttttagaacgcctttttaacgtagtggtttactgggcaaagtttgtcttgctgctaccacattacattctaattcactatgaagtcacacaaacaaagggaaataaaagaaaggcaaaagagccgcagtggttttctttataatttccagattttgtggttttcttgtctcttgtttcaacttttctagaaagtagtacttgacagttgtttgtaggcagaaagaaaacagaagccattctgactgtcatgaaagtgaaagaagggaagtgactttcccctgactaattgcaaagtgtaagttagcaaaattcaatgcagcaaaaattgaggactagagcctctggcagagtgaaaacataacgccaatgttgaggtgcacaaaggcagaaaaatggctgcatctgccagaggttctaagaaaagcaattcctgggtcaatggactgaattcagctttccaagaccagctacttgactttctttcatataattcacatgtgatcagctctagacagaagggagaagtcacaccaatcaattcccaaaagcctgtaagcaggctgcagtcgctagacaaccaacaaagttgtctggcaggataatgcatattagccttgcctaaagactccacctagttaataaatttactcaggcaatgaaaacatagccttgagaaaccaggaattaatggaagagaattggatgatcccaaaagattctattttaatctggatgataatatcaaaaatgataacaccaacatttattgcaggcctaatagggaccatccactgttttaagattttcctttttgagactgggtgtcactctgtcacccaggctggagtgcagtggtgtgatccctgcttactgcagcttgacctcctgggctcaagcaatacttctacctcagcctcctgagtaactgggaccacaagcaggcatgaccacatatggctaattttttgtagagaccaggtttcaccatgttgtctagactggtcttgacctcctgggctcaagcaatcctcctgcctcagcctcctaatatgctgggattacaggcatcagccactgtgccaggctgttttatgatgttttgaaaatactatctctgtcctctcaataacactatttggattatactcttttataaaactattgggagagaaatataaatctgcagggatgaactattctgaccacaccaataatgcaaggtcgaaaccttagggagaatcattataatggcttgactggaaggacccattaaaggaaggggggatagatatgaatttatcaaccaaggagagaccagggcataaaatcaatacagcagagagggtgagatgacaaaggattctgagattcattttgaatgccaaacatttgctcgtgctgtatagagcaacagggggtgtggtgtaagtgaattgaattaactgcctttaagttctaaggaaaagtagactaaatatattccttttttttttttttccttttttgagacagagtctcactctgtcgctcaggcaatggcgacatcttggctcactgcaacctccacagcctgggttcaagcgattctcatacctcagcctcctaagtagctgggatcacaggcacctgccaccatgcccagctaatttttgtatttttagtagagacaggatttcaccatattggccaggctggtctcgaacttctggcctctagtgatctgcctcagcctcccaaagtgctgagattacaggcatgagccatcatcaagtgaaaaaataattagtgatgtattcaaaaatatactaaaacaactctattaacccatcaactacaaactcctggaagccaatttatttttttactcttgagtttttttatgtattaagaataaagaaaaagcaatgaacaatttccaggacagcccagcagtacatgctctgattttttgctccttcaggactcacaggtcagcctccccatcaaacatgtaaactatagagatgtaagatgtccccaccaaacatctaaactgtatagcatctaagcagcctaaggctttcaccagatgcccagcactttgggaggcagaggcagatggatcacttgggctcaggagttcaagaccagcctggccaacatggtgaaaccccgtctctactaaaaatacaaaaaaaaaaaaaaaaaaattagccaagtgtggtgaggcatgtctgtaatcccagctacttgggaggctgaagcatgagaatcgcttgaacccaagaggcagaggctacagcgagccaagattgtgccactgcactccagccagggcgacagagcaagactctgtctccaaaaataaaataaattaatgaaagaaagggccttgtccatattaatcgaatcttgagtgcccagggaagcataaccacatgaacctgaatgaatatatcctagaagaagaaaaacactagagaggctcattcactaataaccatcaacctctgcttactatgtaaactatagagatctaagttgtccccaccaaacatctaaactatatagcatctaagcagcctgaggctttcactagttgcccagtcttccagccagaagaattgtgagccaaataaacatttttttctttataaattactcagcttcaggtattcctggacagtgtaactgaacccaggtgcagctgctcacccctcgaaaaccaaactcaagagatgatagttgctggggtcgggggaagcaggttcattaggaaagccagcaaactgagaagatggtggactagcatcataaataccatcttaagacagaaccaattttaggctctttttatgttaagggctagcagaagaggagggcgtcaggattaagaggagaccttcaacagtagacatctgggcaccagcgagggtccaaggagtttggaaaattatttgttcttggtcaggtcacaatgctcctacagtctttaacaaaacatagttgtttacatccttcttcttgaataccagagttagttttaaaaactacatgactgttgtttttgcacattatctcagtgctctaaaataatcccaatctatgtgcaggaatgggtgtaggccccataaacaaaatggagttcgttatgttaggtattttgctgtctcactgctacaactgcaacacaaaacgaatgcttttaaagggctgcttgccaaggcaagtctggctttaactacaaactcagccacattgcttagtatggttgtctttggctgtgtatggttgtctatggttggcattataataaatgatattttcctgtcatagtagtagaaagttttatcaaaaaataaatgtttacaaagtgaaaattgtaaggaacacctcttacaaccaagcagttccaaagcaaacagaaacaaatatggtgggctcgctgagcactttcatgcattgttgtgcatctgtataagtgtcatatgctttgtgaatttttgttttgcaatcatttgtactcattcattcatttattcattttccaatgcacttattccatttcagggtcaagggtggcaggaacctatcctcacagatcagggtgtaaggtggaaacccccactggacaggaagttatttaatcacagggcacattcaaacacacacacacacacacacacacactcacacacacacacacactcactgagactggagaaatttagacaaaccaattaacttaacgcgcacatatttgggatgcaggaggaaactgaagtacctggagaaaactcatgcagacgtggggagaatgtgcaaactccacacagacaaggccctggtggggagtcagtttcttctctcatcaatgttacaaggaaatgacatagaatgaaatgacgttattggagggtcttcctgcgacccttctgttcaagaattgtcttcgtattgttggtctttaaaggaggctgcattgtgagcagaatttaagagatcccttggactgcattggtcccatgaataattttccctgcactgtgatgacgtgctaggttctagggagaaaacaaaagtttgcatctggaagtgggttaaccctcatccctcgctgtactctgcaggctgctgtggtgtccctgttacccatgccatggacactgatgttggccacagctcaacagaactctgttctcagcatccactttaatcttctctccttctgataggaatgatctgaacagttgacttaatgctgctcgttggtattattccgtctcctgagtacctgacactgatgtctatgctttaaacatctctgtcctccttccacgttctcaggctgctgctggctcttccagcttattccagtgcatgatgtgcactttcattgtttgaacaaatgagagtcctgtgcctggtgcagtctcttcctgaaggactcagaacttcgaagcttctaaacagagtcacagatgagctcctgcattctttatcagctcaatggacatagaggtataggcaggactcccttcatttactgcattttgatgccagactggacatcagagggtctacacccctacagctcatgactcacctggcaggaagggtggaagtaaggccacacgcacactcttgcttctgaggcttgaaaaacatgactatctccagagggtgcttcatggtgatacctcgccatgtctctctgggcactgggcactgatccctgcctccccacaccttttctcaggtggactagatgttcctgggtggaggtgggcctgggagcagtaaacctgtctcctcagtgggacgagggcagggccagcggcccagcactcagtgtccccaccacgccctcgcctaggtatctcgagacctgctgctgggttccccagtactgtagattatatataacaacttaaaaactctgagatatgaaacgagatatggctatagagatttatcagggcagggtgacaatatgatgccaaatcacaacttttaatataaacatagtataaactataatataaatataatgaaaaattaccttaaaaatgtaatcagttacccaagaatagaaggggttctaatatttgaatggctaatttggcggtcacaaaagacagaaccaagtgaatcaaaaaatgttcccattgtcctgcccctaaactggttccctataagtggtggaggaggaaaggaaaaatggtttaatatgtgaactatggccctctaactcgggaatagaagagaaataatctaatagttggacctctaacctgagtcagacagctgacagatccctgctaaattgaacccttgccctgctagctgagcaattgacacctgcacaattcacacacattttcttattacttccttagttgcaatgttgccaagatgcctctctattctaccctgttgacacctgtggcaatcactgcattctctgaagttcctttatttatgtcagtggtctctctattgaatcaaggtggaattgatgcaagctcattccttattcaaagggagagtgaaaactttctcaattataaagttgacagaaattatctgataggaggaataaatttgtaaaactgacaacttactcaaaagagttaatgtgccttcaaacaggagagttttcctgatttcccttgaagtgccacagtcagatgggatggctctcacctccatgtgacctgcagtaagtagagggagggatgagtcaggagaccctgggaggctgcacaggctggaagcaggggacacatcctgaccttttctctccccagggttgcacattgtccaaagaggacatgtcctgcctgaagctgggagtattttccctctctaagatatgaaaattaaagaaatgggctcattccagtatttgggtcagttgtttccaggaaagttcctctttttagctctgaagaaaaaggtgctggaaggagacagacttatacaaagaacagactttcccactgtctctggtcttggcaggtaggtggctctctcacagtgtgaagttacccttgataccccaaaagccaaagagatcagggaactcacggcaagggagagcagagctccagacatgagaaggacctacccatgactcttggggcttcatgaggaagacaggaaactctatgtagtggggcatctgtggctactttctctctctctctcttttttatttgcattcttcgaggagtcccaggctttctagaagtattctctacaaccctttatgtggtagccagaactctgatgtttctgcttagtaattttccatccactgaccaccaaatgcagaggcaggggcttgtcaatgataagagagagctagatgaacgactgaaaatggcagaagtaaatagaagaacaagtcttagaggagccagactggggagatcttaagcttcttcaaaaggccaatgaagttttacatttttttaagcaaaaatcctgcctacaagaaaggaagcaaacagaggattcaaatatataatttaaaaaggcttaagtttacagaaaaaatgtttccatgggataaacaagatcccaaggagaaaatcagaaagacccttaaaaaatggtagccttgatacccactttaaattaagctaataattgaatacagagctcttaaaattactttaaaaccccttaccggatttcggcaagaacaaacaacccatatttctaatgtttgaaactttcttttttctcttttcttttaaaacaaagacacctaccaagtgactcagtaccaaaaccaagccttttttgacttcaccaaggatgcataagacatcttcaaagaaatgccaagatgcagtcctctcaaaattcagagccacctctaaagatcgccgcaagaaagaaatatttagacacctcgagagctggcaatagtcaatatgtaaacttttaatgggcgcctccaacttttggtttggcctcctgcacacaccgaagggcatcctgataggcagcaagccaagtcaggttctcaggacacaaaacagcaaaacgacagctgtctattgaagggaaaggatcaataacacatgggtcccataaatccaaatttacacaagagaacaattcaaacaaatgatcttctcctgatgacctgcatttggaaaggaagaaataaagataaatttttacctttagttcttgaccagacactacaagcagaaattcagaactgaacttggtaaaaattcttacctttactggcaagctctttatcagcattttacctggacctcatcagtaggtgagtcaggtgcttcaggcatcccatcttcatcaccacaactataggggtagaaatagtgtgatctctttccttcctatcaaaagggtcacagctcacacgcctaaaacaaaagacagcttaacaagagagaagcataacacatttatttaatcacaggtttatataactacggaagccttcaaaatgaagacccaaagtacaggaaaaaactatccatttttatgcttatgttccatgaagaatggccagctgtgtagaaatgtgattagacaaaaagggcatcatctaatgctaatattctgagtaggggaaacccaacaaggcctttctggtcagatacttcttggcccctccatacaccattccttcctcttgggtatgtggcagagctctttttggaatgggggtcttagtatctacaatcaaacaaggcaggtgagagaatttctttatggccagttcagttcttacacacaaaggtgagggaaagttagagtcatattttcagattttatggctggctttggggaaaagggtctccctcaggagatgaggcgtgacaaacagcagggcaggagaaggccagagagaaactttgcttctgaagctgcttctgagaacttcactttggggtattatttttgagcctcaataggagtgaaaatgagatccagaaaagctggggaagaaggaaagaactgtgctgggtatcggaatcagcaaatgaatggtatgtatatttcacttaggtttaagaaaataaactcttccagattttcctgtaagataccgtatcctgactgaatatacacatcagacttatcttcagtacgaagggtgactatttttcagttttctccagaatactccaagaattctgcgttttagattcttatgtgttatggagattgaggagagaagagaacattcccttttctgttttctcattttcttttttttcttttcttttctttttttttttttttttttttggggacggagtattgttctattgcccaggggctgtagtgcagaggcgccatctctgcctccggggttcaagtgattctcctgcctcagcctcccgaatagatgggatcacagctacccaacaccatgcctggccaaatttttggtttttagtagagacagggtttcaccatattgtccaggctggtcttgaacccctgaactcaagtgatccacccaccttggcttccaaagtgctgagattacaaacatgagccactgcacccagtcccttttctgatatatatgcactaattaagaaaataataaccatatatttataaaataagaaaataagcatatatacatatgttttatatatatacactatatataaaatatatatatagtgtgtgtgtgtatgtgtgtgtgtgtgtatatatatacatatatatacgtatatatatatatgtacgtatatatatacacacacacacacatacacacacacacacacacacacatacattctagaggctggtctgcctgagatttaggcagagacacagttccagaccatattaatcaccattgtctctatttgtccatccctctgtttcctttgtggctcttctcttccttccctttaaaggtggaaggtccttagaatcacgtttaagtccttttctctgtctacactctctccacacatgagcactttcatttctgggattttgcttgccacatatgaactcccagcaattgcattccttataatttgcaaactcacatatccaactggcaatagacagtttctaccacatgttgtatcagtcaacttatagaggatatctgtttatttttatttcctcacatgtttcagtttacctcctgccgaaagaaatcattgttcattcctttttctccttatagtattcaggataactgatactaagtatgattactatttttagttttattccatacaaaaatcaaacatgcaagagagtaggaagtagatttattgtattcacctttataacttgagtacaacatacaacctggtttagagaaaggtcatttttacttacatctctcatataataatgatgagtaaataaattataccctttattctctcatcaggttgcacagtcaggctaggaattttgtattaaagaatgaacacatacaggaagttcctatagtaaaagtttaatgaacaacataaaataatgaattgagtagatataaggaacatgttttattacactaaccacagtgtaaagatgcacatgatgttatatgaacaaaaataatttaaatcttatgaatagctaaataaatatttaaatagataaatcagtttatcagcatggtcatagttatagcagaagtgagagtctttgaaatggcagaattcatgaaagcgtgacctggtatatgagtcaataagaattgtttcatgttggaccaggtgttattccttcctccttaatctttcttgcaagtttgttgataaagagagggatctcatgatttctgctctgacaacctcccaggcacaagggctgtatttcttctctgtcagatagagagtgattcttcggaagtatttcttcacagccaagatggagtccgcattcatcaggggagtttctcccaccctctcctcctgcatcacacaggcttccaagtcattcagctgctggtagagttcggtgcagaatttgtctaggaggtcctcatcccaagcagcagatgaatcttttgtggtaaagaggttgaagatctgctggatcagctcatggaggacagagatggctggagccttctggaactggttgccatcaaactcctcctggggaaatccaaagtcatgtctgtccatcagacaggaggaaggagagattctgctcatttgtgccaggagcatcaaggtcctcctgttatccaggctgtgggtctcagggagatcacagcccagagagcagcttgacttgcagctgagcaccaccagggccatcagtaaagcaaagggcgaggccatcatagatattgcagatgcttctgggcttgctgagatgggtgactctgaaccttgggctctaggttctctgaaggctttgcttcctgcagatgccttaaatagggaacatactgatttccactttcttaatgcttctggaccactttccatttctgtttttgctttccttcttgaactctttacatgagtttagagccgtgtttctcaaccattttgtttttcattattgtctcccccatcttgttcccagagactttttagattttttttcctaattgaacccaccgtgaaaatttaataacacagatataatatctatctatttgtgtactatatgtatatctctatactcaaaaagtacaaagtttaatcattttattcaatgcaagtttaaaaataaccaaatgaaaattttaagataaaagttaaatttaaacgctattcaaatttaacttaactttataactaaatttgcttgtgggcttcaatatagtttatttactgatataaattgtaatgtattaaattacataagaaatttaacaaattataaacattatctaatgtttctagataaacattatacagctaagtaatgaatgtttatgaattatttgaaactgataaagacttaataatttaaaatatttttatcatttatttttattatacttaacttttaattttgttgcatgtgagaaaatttttaacttcactagctgctagatactcacctagagagtgtgaagaattttttcttcaattcttgacctaaatatagatgtgttgaacaacttcagtagaattgttaaaatataaattatttatatttcatttcaaagcccacaacacagacagaaatgctaaggatcaaacataagcaatatctataagatggccagtgacaaaccatatgtatgcagaggacacctctcatgatatgactttgagatctaatacatcttggaaagtactccaatcacagctacccatttgccataggtttgtaatgctgaacttttataccttttgtgtatcttccatgaactcaatgtcagtgcttctcatgtgatacacaagaaaacccaatggagagaaaaaaaaaaaaactaaggaataagattttgttaaataggttgagctttgaagggccacaaaccatttaaatatgtaagatttgttcccactcccaagaactaacttctacatccttgggagtagtatcatatgcaatgagaatacacaattgaaaaaacatcctcgatttgattaaaaattttttgcatgaaagttcaaatttccaaggtgccttcagaggttctttgctgattcctagcaaactaaaggaaactatctttgtcctagatgcgcataataggatgtaaatataataacataaataagtagacaattgttttacatagcatgccagacaccagatatctttctttctcatttcattttcatagaaagcaaaagttgtcactttttgcatcctaactaatgggaacaaaaagataacacaagtggccgggcgtcgtggctcacatgtgtaatgccagcactttgagaggccgaggcagacggatcatctgaggttgggagtttgagaccagcctgaccaacatagtggaggttaaggggtgggaaagaacagaagcaaaatagtagaagggatgtaggtcaaggtaacacgtaagtatgggctggaagaaaagtaattactcctggtccacagtgtgttttcagatttaccgaaccccatcttgcaaatataccaactgcaagagtttatacacaagaaagagaaatttttgagagtacaatattctctctggaaaatgggtcagtgttcattgcaccaagctctccactattggataagtaaacttagaaggtcagtttttttcttcttatatttctagtaagaaacaagagaattgataatttcagaggacacttccctaacttttaatagagttatataataaagataatgttaataagagaaatgaaatatcaggccgggtgcggtggcttacgcctgtaatcccagcactttgggaggccgagctgggcagatcacctgaggtcaggagtttgagactagcctgactaacattttgaaacaccgtctctactaaaaatacaaaattagtctggtgtggtggcacatgcctgtaatcccagctgaagcagaagaattgcttaaacccaggaggtggaggttgcagtgagctgagatcatgcctttgcactccacttgcaccccagcccaggcaacaagattgaaattccgtcttaaaaaaagaaggaatgaaatatctaaattgtggaaagtctttatttattttcagtcagacactgtttttagcacttgcataatcaatgcttacttaatcaataaagaatatccatttttcatatttactgaacgtctaccatgtacctagccccatttattcactagatatatcactgaccaaagcacacagtgatagattttactattatccccatatgcaaaagaaaaaaaatgaaatcccagggagctattaagttgtggagccacagtttggatggagaaaattcagctctgaagtcttacttcttacatgctctctgggactatttctggacaaaagaaccagagctgatttctaggacaatcaatgttttcctagtagagtccttactatgtaatgacagggtctttctcttcagtttccatttgtcttcttcattgaaatgccccatttgtccatgccaacatgttacattacaattaaattgggccccactttactttcacattatattctagttttgtcttcttgaggatacaccatcataagcatgaacatatttgtaaaacatattgttcaccccagtgaatatattcatcaaccctttatatttctgtcaatttaaaattctacatagtactattcttttaatcaaatatccacaatactttagatttccccatgtgtagcacaaatttaagaaagaacgagtcactgtcaggctagagacatgaactaaatcagaactaaaccaaggaactaaggctcagagctcagggagagcacacctggaaaggttgactaaagggattattaaaggtgtggaaatggaaacacttctagagaaattaggatagtccatggcattagagaatgaggactgagatgacaaaagaccctgagtcacctgacttgccagctggttgatgctttttatgttgcaggtcaccagagtgtgctgcagtgttgattgtactgccttaatttaaggatctggtaaagaaaaatttatgctgacacttggtataacagtaaagaagacttattcagaagtattgcaacaggcgtcaaaactatcacaataggtgtattagttcttgcactactatacagaaaaacctgagactgggtaacttagaaagaaaagaggtttaattggctcatgattctgcagaccatacaggaagcatggctacggaggcctcaggacacttacaatcatggcagaaggctaaggggaagcaggcatgtcctgcatgactggagcaggaggagagaagcaggggaggtgctgcacaattttaaacaaccagatcttggaataactcactcttaccatgacaccaccagggggatggtgttaaaccgtgaggaaccgccctatgatccaatcacctcccaccaggccccgcctccaacactggagattacaattccatgtgagatttggaaggggatgctgacccaaaccatatcaataggggagagagaccaattggtgctcagctcaaaaatcagcaaagagagcctggggtttatacccaacaagcagaatgaggggtcagatagaaaatcagtaaaaggagacatcaaaggcagggggatccttcctaagctgaacataattctttctaaaggcaagccagggtaattacatattgagtgtgtgggatgaacaatttgatcatatatcaagggtaaatcagctatcaagcgtggaagcattctcataaaactaacttagtaagattcctgctacaactggacttggcagacctaagaatggacccaaaggcacgagccagtcaacgagagagtttggaggagactgactaaagtttggcaaaggacagagtcattgtcagaaccttaaggggtaagagacagaactgtctgctaaacagttacaagggagattaaattttatgtcttttgaaaacaataccatttaatgaaagattttaatcagtgaaataaatatttttaaaattttaatcagtaatgttaaaaattctggaagccgattcatttttatcttgtatttcgaaacaattctagacctatagagagttgcaaagatagtacagggagttctcttcccttcactcagcttctcctaatgttaacaacttacatagccatgaaacaatgatcaaaactaagaaattaaaagtggtgcattaatatttgctaaacttggccagtcactggtggcttacacctgtaatcccagcactttgggcggccaaggcgggtggatcgaggtcaagagattgacaccatcctggccaacactatgaaaccttgtctctactaaaaatacaaaaattagctgggcttgttggctcctgcctgtcgtcccagctactcagaggctgagacaggaggatcgcttgaacccgggagactgaggttgcagtgagctgagatcgcgccgctgacctccagcctcggcggcagtgcgagattccgtctcgaaaaaaaaaaaaaaaaaaaaagaaaaaacaaacaaagaaaaaatttgctaaacttcaggcttcattgtgatttccttaactttttgactgatgtcctttttctgatttaagattcaatccagggtcccatattacatttcattgtcacatctctttattctcctctcatctataacatgggctgagtctttcctgactttcatgacctggggactattaaagaatattggtcagttactttgtaggatgttcctcaatttggatgtgtggaattttctcatggttacattatagatttaatggatgaatacaatggagtacatgctcattacatcgaataatataggaagcatacaatatcaataacttattgctgctgatattaaatgaatcacttggttaagttgttgtctgccaggtttctcctatgtaaaattactatttgtccctttccatactgcttgtgtcagaaacatatcacgaatatgagcccacattaaagggaggataattacatagagaacaatgtatacaagaatttgttgatgtatattaaaacatcacagtaattttttttctcttctcttttttttattattattatactttaagttttagggtacatgtgcacaatgcgcaggttagttacataggtatacatgttccatgcgggtgtgcagcacccattaactcgtcatttagcattaggtatatctcctaaagctattcctcccccctccccccacccaccaacagtccccagagtgtgatgttccccttcctgtgtccatgtgttctcattgttcaattcccacctatgagtgagaatatgcggtgtttggttttttgttcttgtgatagtttactgagaatgaagatttccaatttcatccatgtccctacaaaggacatgaactcatccttttttatggctgcatagtattccatggtgtatatgtgccacattttcttaatccagtctatcattgttggatatttggattggttccaagtctttgctattgtgaatggtgccgcaataaacatacatgtgcatgtgtctttatagcagcatgatttatagtcctttgggtatatacccagtaatgggatggctgcgtcaaatggtatttccagttctagatccctgaggaatcgccacactgacttccacaatggttgaactagtttacagtcccaccaacggtgtaaaattgttcctatttctccacatcctctccagcacctgttgtttcctgactttttaatgattgccattctaactggtgtgagatggtatctcattgtggttttgatttgcatttctctgatagccagtgatggtgagcatttttcatgtgttttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgcaaaagttttctcccattctgtaggttgcctgttcactctgatggcagtttcttttgctgtgcagaagctctttagtttaatgagatcccatttgtcaattttggcttttgttgccattgcttttggtgttttagacatgaagtccttgcccatgcctatgtcctgaatggtattgcctaggttttcttctagggtttttatggttttaggtctaacatttaagtctttaatccatcttgaattaatttttgtataaggtgtaaggaagggatccagtttcagctttctacatatggctagccagttttcccagcaccatttatgaaatagggaatcctttccccattgcttgtttttctcaggtttgtcaaagatcagatagttgtagacatgtggcattatttctgagggctctattctgttccattgatctatatctctgttttggtaccagtaccatgctgttttggttactgtagccttgtagtatagtttgaagtcaggtagcatgatgcctccagctttgttcttttggcttaggattgacttggcgatgcgggctctttttggtgctatatgaactttaaagtagttttttccaattctgtgaagaaagtcattggtagcttgatggggatggcattgaatctataaattacctcaagcagtataatttaaaaatcttttggagggtgatacattgaggatatgcgttcatcctcaattccttcaaagttttgctcacttgttttatgatttgcctgtgaatcttgcctattacaattatttttcggtgatattccatttttctcattgtttctatatttattattcaaaatgtttctgaaagagttggccctcctctccgatttatgattatccacccactcatttacttatatcagtatgaactcatggatatttattctattatttgggttataatcaaatactatcactattttgttgctctacttgtcccaactttggctattggaagctctttcaggttgactcctctgtgtttttgatgtgcacctatagtttttgtttctgggcccttccctatcttctgataccacaagatactccagagtatcctggtacttccatgccctatacctggaatcatttctttctcccagaagtcctcatgcattttattggacattggttaaatgccaatttagctgagcaaataataaatgctaaaaaatgagaatatatcaatttttcaaaattctaatccagcataataaggtttattctagccttaccattttgattatttgaaacttcttttcccaattctgagatacctggcttatattatccacaagattttacttatttatttaaccctagtaattcatgttaagtagttccagaacaactaaccagaatccctgtgagaaaccaatctaccacctaaagcgtcatacctatgtacagctctttcgtcttcagccttacactctgtagtcactaaatggttggacagagtatttgtcattatcaaaaggcttttgtcatatattcatcacattattttttcatagtctccattcaactttggtttctgttgccaatgtggttgattttttaaaaatacatacagtacaatttacatcttttgttgactagttccccaggttttaaccagtgaatacaggcacagcttatctatctttacttgaagttttcttgtaagtttaaagctgaacaaaactttccaccaatttataccatgacagtgcctaagcatgcaagatctgacgtttctcctttaggtcgttgttagttgcattgatgaccctcttgaggtcagtctactgttttaattaccaacaaatatacatcgaatctcacatattccccaatttggaattcttgttgttctcccagatgatggagccctctgaaggtcttgtagaggattctgtgaagaaggtggattagaaaacaccagaactcagtctccccatctagataacagttgcaatggcaaaatctacctgatataactattttggaactctggactatatttcaggcttggaacttccaggggaagtcttggatggtaaattgtgattaatttcagtcaattttagctttaatcacattagtatcaacagatcctctacagttttccacacctagtctccatggcaggcagctgtgcccatgttccaagagcagcttgcactgagctgatgggagccagtgttggcaaaaagcatactttctccaaatatcagggacctgtgtcctattttctggttgctgtttttgatcccctttgttgcaaggcccaccctccagctgaagtgacttccaaggtatgaaacagccagcaccctccccatctcctcctttatttttttccccttttcggcaaccgggcattaaaaactaggacattcaaggtgaaagttagagagtgactgcatatgtctagggaaaggtgcagactcagaaacaccctgagaagaccttaagatcatacctcaggacaatctttacacagagacagcctgcaacaatcaaatcaagaacaaaataatatcaacaatcaccaaagactgggtaaggggttaatcttatttccagaattactacattattagatttgaatgtcgagttttcaacaataaaaataatcacaattttctgtgttaatagtacattaacacataaaaatatggcccattcaaaaaaaggtctcagaaatcatacctaaaaaagatttgatagcaaatctacaagataaagactttgaagtaactcttaaagatgctcagagaattaaaggaagatgtggagaaagtctcaaaaatgatgcacaaacaaaatgaaattatcaataaagagatagacaacctataaagaaaacaaaaaaaaaatctggagctaaaaagtgaaataactgaaatgagcactgaacattttattagagggatttaaaggcacattggagtagacagaagaaagaattagtgaacttgaagataggacaatgaaattatcacgtcttagaaacaaaacaaaaatgattaaataaatgactcaaatctaaaggaaccatgtacaccatccagtggacttgaatggggagaatcatcatgacctgtgtccccaaataattgtagttttcttctcattgtttaatcatataatggcttttgaatatatgtgttaatgagtaagttttcattggccatttcctcttactttcatccagattgccaggtatcaaatagcttgatgtcctccaaatggcatggtcctgcagtcctttcagtctatgagaaatcgtgaacataagctttaggatctgtccttgatgttattttcttgtagctgctgattaggctaccaatacattacccaaaaaaatgcaaaatcaatgttggaaacattgttaatgatgttcagtaataaaaattactgaaataagcactgcttcctaataagacaagaaaatacatgatagtcatccaaatagaaaagaagaaagtaaaacttgtttatgaaaaatgacttcatcctctagaaaattcttcagattctttaaaaaatatgctagaatttactagtcaatttatccgagtcaatatacaaaaatcaataatatttctttatatgcgcaacaatcagaaatttaatctttagaatataatttataatattatgaagcatttaaaatacttaggaataaatttataggaagacatatacattgaaaactataaaatattgctgatagaaaatagataagacctaaacaaatggagagatatattgagctaatggattaaaagactcagtaatgttaagatatcagttataatcacattgatctacagattcaatgcagtatcagtcaaaatttcaccagacttttttctgtagaaattgacaaacagattctaatatttatgtggaaatgcaaaggaacaaaaataaccaaaataactcgaaaatgaagaaaaatgttggagatctataatctctaattttaggacttatattactaaagtaatcaagacagtgaagtattaaagagaaacaaatgtatcagtgaaagagacaatagtttgcacaaatagaacctacatatactgtttattgattctcaacacaagcacaaaaagcattcaatttttaaaaagaaaaattgagtaaacaagtagtgctgggatacacatctctataaaaatgataaatcttgacccatattttacagaatatacaaaaattaaattttgaaatgtgctcattccagtatttgttcagttgtttccaggaaatttcctctttttagctctgaagaaaaagccggtggaaggagacagacttatacatagaacagaattggccactgtctctggtcttggcaggtaggtggctctctcacagtgtgaagttacccttgatacccacaaaacccaaagagatcagggaactcaaggcaaagaagagcagagctccacatctgagagaaactacccatgactcttggagctccacgaggaagacagaacaccccatgtagtggagggtccgtggcactctttttgcatgcttcaaggggtcctaggtttttttcaagtgtctcctacattcccttttgtggtatccggaactttgatgtttctgcctagtaattttctgtccactgaccaccaaattgaggaggcaggggcttgaagggtaatgtatcgatgataaaagagacctagatagaaaattgaaagtggcagaaggaaggaagtacagaaataaatggaagaacaagtcttaaaggagccagattgggaagatcttaagcttcccaaaaaggccattgaagtttcacttttcttttcagcaaaaattatgccagcaagaagggaggcaaacagagggatcaaacatataattaaaaagaggtttaggtgtaccgaagaaacttcccatgggagaaacaggattccattttaaatctcttatcagatttcaacaagaataaacagctaatatttctagcttttgaaattgttttctttttttccttttctcttttaaaacaaaggtatctaccaagtgactccaaacagaaaccaattaagtcttttatgattaaccaaggatgcataagacatcttcaaagaaatgcaaagatgcaaccctctcagaattcaaagtcacccctaaatcacccctaaaaatagccaaaagaaagatttagacactttgtgagctagcaacagtcaatgacatgtaagcttgtcatgggagcccccaacattttttttggccacctgcacatgccgaagtgtgttgtacaggcagcaagccaagccaggttctcttgacacaatatgagacaaacagggacacaatagctgtctatggaagggaaaagattaataacaaatgggtactttaaatcaaaactacacaagaatcacaatccaagctaataattttctcctgctatcctgaatttggaaaaaaagaaagagaaatttttaccttccattcttgaccaggcactataggcagagatccaggagaacagaccttgatacaaattcttacctttctttgccaactttttgccagctgtcccaggacctcatcagtaggtgagtcagttgcttcagccatcccttcctcatcaccgggactataggggcagaaatggtgtgatctctttccttcccatcataagggtcatagctgacacccgtttaacaaaagaaagacaggttaacaagagaaaagcaaagcaaagcatatttatttaattatagttttatgtgacatgggagccttcagaatgaagacccagagttacataaaaaaattcattttaatgcttaagttcaatgaagaatggacagctgtgtaaaaaatgtgattagacaaaaagggcatcatctaatgctaatagactgagtgcggaaagccagcaaggtctttctggtcagattcttcttgacctctccgtgcagcattccttcctccctggcatggggtagagatccttttggaatggaggtcttataacctacaattaaacaagatagttcagagaatttctttagagccagttcttacacagaaaagtaagagtagtatttttaggttttatggcttactttggtgaaaaggagccttggaaaagggggtttctagtttttatggctaacctctagagaacgaggagtgagaaacaagagaggaaaaaaagatcagagagaaaatttgcttctgaggctgcttctgagaccatcacttttgagtattgttttttctgatccccaacgaaagtgaagaatgggattcaagaaaacaggggaagaaggagggaattctgctaggtatcagaatcagccagtacatattatgtatattttacttcagtttagggaaacaaactgaatatattatgaaatatattacatatatttcataagctaccatttcctgactaaataaacaaatcaaacttaccttcgatgtgaaggctgactatttttcaatttactccagaatgcttccaggaattctgttttttagactatcacattctcgaacgtagtagttactgagtttgaggagagtgttcaatattctgataaatatgtataaaataagaaaataaccatatatccataaaataagaaaatgatagccatatatgtgtatgtatatatcaagttctagatattcatatatagatatatgatgttgactgtgtagcttgaggaaaagattcaagagacccctctgcagttgcaggctctcactccctgctacctcagaaattcacacacactccctgggaaatacctccatgagaatatggtaccaattacaggaatgcctctcaaattctaccaatatggacacatttagataaatagacttcactgagaataataataataatattcttttatatttcttagcttctgtgggatttttccctttttctaactaggtacagtttttattgctgagttgaggagctgtcaagattactacctaaagttacagtaagaaaatgttgatttgttaaagtttgaactctgacattaggaatgaatctgtgaaactaagattgcactgtcaagagtttaatgcactaagaaacatgatatttttgtgaatagtattaagttccaatccaaactggcagttctgtgtatccccaaggatcccaatatatgtggaaggggtgatcctagggagcgtagactggtctacacagtaggctgtgggcagggaatacatgtttctctgtccctataactggaaatcccaaggagtccacgccctgactttagccagaaactcactctctttgtaatagaccaagggtaaggaaacatgcttatgacagcatgagtatctcttctggccaagaagtagcctttttgcagcatgtggataaatccccagaactggtagaatttcttcatagatcagcaacctgcccctccagttttggttgctgcccttatcactcttggccccaggggactgtcttcccctgagaggtttgcaggagcctacgtataaactgaattctgctttctctttcctttttgctaagctactgttatgtcacatttaatggagattctagaaaaccccctttgcatgtgtttctgtaaaacctagaaattttatttcacttctgctttctccttgtggcattctgctctttagggaagccatatgaagccagaaccacaatagaacagaaagctgctctgtgtgaatgggcaggaaagtcaagagaatgaatgaccagggtcccatgggaaatccacctcagagagcaaggaaaccctggtgatatggaaatgcctcctggaatgctgagagccagggagggaatgtgtcaggtgcctgaatcagtaaataaacatcacatgtcttctgcacgtcaatctatatgtttattctcctgtctcaggtatttatacaagccaccattccccgactgcatataaataggacacttctttgaaatgaggagtgactgtttttcaaccactctacagttgctgacagaatctagtttttttaggctgctgccattggcagtcacttactgaaatgcaggacacaggtcctaagaattttatagaaagataaatattatcctcatctacagctgtatgaagaaaatagggaaatacctatcatattttaacttcttactagataggagacacagtggtaggtgctttaaaatgcatgttttttctaatattcacaactacataaatattttaaacccaatttttatgagaaaagtgaggctcagtgagaataagtgggttgatcaacaccacacatacatccaagcagaatgaaatttcaacgttaaagtctttaatgcaaattatgagtgattttgtcagtttggttttctggatttctattacaattgctaaatctccttgtactcgtgaattatacacaactctttggtactttctgaatttccatggttcgggttgtatttttagctggtttgactaatttttttctttcccttaagtatggaggaagagattctctgatccagtttcctaatttaatttgtgaaggaagtttgtcagtttatatgtttatggtaatttagttatttttgtattcatgtaagattgtaatattcataaaatccggaaaaattaccaaggagtattataaaagatttcttatcatatctggctctaccggagaaatgcagtcaagttgtagtaaactagcatgacaatggcgcaagttaagtaacttaattaaagccagtaattgcagtaaccattatattatcaatattaattgaatattttgatgaaagattgaattagttatctattcctgcctaaataattaacaaaactaggcatcttactgatagtcacagtagtattaattaaaactgataaattactattgtaattaaatatgccgtgacttaaaataaatatatgaaatatattaatgtcatttgccagtacctcaattacatgaaatctattgagaaaaatatacattgcaaaaaaggaaaaactatgcccagaaaacataacccacatcctttcctaatcccattttatttctttctccacttcagttcactaacttatcttatttaaacttcctccaatatggcttctgtgtattaactttacccaatcagttctcactaagggtgccaatgccatctatttcccaattagtaggcagtttcaagccacaccttgggcaaatcgactgaatcctcttctcggcacatttatttccttttgtttgtttgttattttgagatggggtcactctccctctgtctcccaggctcgagtacagtattgtgatcatggctcactgcagccttgaactcctgggctgaagcatttatcttcctaaatacactttcattatctttctctgctgttgccttctaatgtacagccattcctttgtggctgtggatgtttcctttgcggcttttctctcccctccctttaaaagcgaaaggtcctcagaatcatgtttaaaactttttctctctctacactctctcccaacaccatgaccttcatttcttggctttctcttatcacatataaacccccagcaatcgcattccttgcaaattgcaaacttatatatctaactggcaatggacattttctaatagatgtatactagtcaatttaaagagaatgtctctgtcttatttttatttcctcacatgcctcaatctaccttctgcagagagaaatcatcggttgttccttcttctcttcataccatttaccataactgataattaagtatgattaccatttttagtttttttcatacaaaaatcaaatacacaagagagcagaattgtatttgttaggttcaccttgttatcttgagtacaacatacaacctggtttacagaaagtttatttttacttatatcttgaatataatattgatggataaatgaagtgtaccagttattctgtaatcaggttgcacaattaggcttggaatttcattttaaagaataaacaagtacaaaagtttccatagcaaaagttcaatgaacaacacaaaataaatttaccaaatacaaagaacatattttattacattaaccactgtgcaaaggtgcacatgacataatatgaacaaaaataagttgttttataaatagttaaataaataatattttaaaaatatttaaatagataatggatcagtcagcatggtcctctgtaagggactagtgccttaagagctgaatacaatgttgattaatactcctaaaaacatttgaaaagatttaaatcgtgtcatggtcatagcagaaacatgagtctttgaaatggcagatcataaaaaggtgagctggcatacgaatcaatgaaaatcatttccatgttgaaccagttttcattccttacttcttaaactttcttgcaagtttgttgacaaagaaaaagatctcatgatttctgctctgacaacctcccaggcacaagggctgtatttcttctctttcagatagagagtgattctttggaagtatttcctcacagccagaatggagtcctccttcatcaggggagtctctgtcacccccaccccctgtatcacacaggcttccaggtcattcagctgctggtagagttcagtgtagaatttgtctaggagggtctcatcccaagcagcagatgagtcctttgtgctgaagagattgaagatctgctggatcatctcatggaggacagggatggtttcagccttttggaactggttgccaaactcctcctggggaaatccaaagtcatgtctgtccttcaagcaggagaaaagagagattctcctcatctgtgccaggagcatcaaggtcctcctgctacccaggctgtgggtttgaggcagatcacagcccacagagcagcttgacttgcagctgagcaccaggagggccaccagtaaagcaaaggtcaaggccattgtagatgttgcagatgctgctagactggttgaaatgggtgagcctaaaccttaggctccaggttctctgaagaccttgctttgtgcctagccttaaatagggaacatactcgtttacattttccaaatgcccctgtgttactttctacttctctttttgctttctttatgcactctttacatgggttttcagctgtttttctcaccacatttttttcattattgtttccttcctcttttaccccagagcctttttagaaacttttttctgattgaatctcccattatattttaatcacatatacactgtgtatctatttacatatcctatgtatatctctattctatacattaaattaaaaagtataaagttaatgttttattattgcaaagaatgataaaacaattaaaaattaaattaaaaggctattgacattttacttaacttgataactatattcttagagcaacttttttgaaaatagatttttgtgggtacataagaggcgtctgtgtttatggaataagtgaaatatttttatataggcagacaattcataataatcacagcagggtgaatggagtatccaatgcttcaaacatttatcatttctctctgctacatacatcccatttatactattttagttattttataatatataataaattatcattaacagtagtcatcctattgtgctatcgaatactaaatcatattcattttttctaactatatttttgtgcccgttagccatctccattttcccccatatgatccagcaatcccactactgggtatttatccaaaggaaatgaaatcagtatgtcaacaaaatatttacactcccatgtttattgcagcactattcacaatagctaagatttggaagcaacttaggtgtctaacagatgaatggataaagaaaatatggcacttatacacaatggagtactacttagccataaaaaagaatgagatcctgtcatttgcaagaacatggatggagctggaggacattatgttcattggacaacattaaacccattgatctgcacatacctaaccacacttgaatctctaggacaaattccacttggtcatgatgaatgattgttttaatgtgttcttgaattcagtttgctaatttgttgttgaggatttctgcatcaatgttcatcagagatattggcctacagttttctttctttttaatgtgtctttctctggttttatatgtgattaaaatataatgggagattcaatcagaaaaaacactggcctcatagaatacatttggaaagattctgtccacctctatttttttaataatttgagttggattggtattagttttttaaatatttggcaaaattcatcagtgaagccatcagatcctgagttcttttctgggatactttttagtatggcttctgtctcattacttgttattggcctgttcacattttgtatttcttcatggttccatgaagaaatacaaaaaccatgaagaaatacaagaatggttctagaaacaattcttgtatttcttcatggtactatgaaaaaatacaaaacctgaacagaccagtatgttgtatgtttctaggaattatctattttgttcaggttttccaatttattagcatatagtttcatagtatcttctaatgatcctttaattttttgtggtattggttgtcatgtctccttttttatctcagattgtatttatttgggacttctttttttcttagtctgtggtgagagaaaacgtttgatattatttcactttttttctaaattttaagatttgttttgtgacctagcatttggtatatccttgagaattatccatgtgctgaggagaagaatgtgtattctacagctgttggatcaaatgttctgtaaatatctactaggtccatttggcctatggtgcagatgaaatttgatgtttgttaattttctgtctggatgatctgtccaatgctgaaagtggggtgttgaagtctccagttattattgtatgggggtctgtctatctctctctttggctctaataatatttgctttatatacctgagtactccagtattgggtgaatatatatttagaattgttaaatgctcttgctaaatggacccctttatcactatataatgaccttctttctctcttttcatagtttttgtcttgcagtctattttgtctgatataaatgtagcttctgcttctttttgtttgtttccataggcatagaatatttttccatccctttaccttcagtctatatgtgtctttaaaggtgaagcatacttcttgtaggcaatgaatcattgggtctaagggttttttgttttgttttgttttgctttttttttttgaggcagagtcttattctgtcacctaggctggggtgcagtggctccatcaatcttagctcactgcaacctccacctcccaagttcaagcaattcttctgcctcagcctctctagtagctggaaccacaggcatgtgccaccatgttcagctaattttttgtatttttagtagagacagggttttgccatgttggccaggctggtctcgaactcctgggctcaagtgatccacccggctcagtctcccaaaatgctgggattataggtgtgagacaccacgcacagctcggtgtaatattttttttaaaatacattcagccactccctgtcttttcattggagagcttagtccatttacattcaatgttattatttatgaggacttattcctgtcattttgttattcattttctgattatttgatggccttctctttcttattttcttcctatttgtctttcttttaatgtaggtgattttctctggtggtgtgttttaatttctcctttttattttgtgtgtatttgttgtatgttttagattggaggttaccatgaggcttgcatatagtgtcttataacccattattttaaactggtaacactgattacataaacaaacaaaaaagcaaaaaaaaaaaaaaaccaaaaaatcagacttcatctccccacttttaactttttttgtttccatttatatcttaactgtattgtctatatcttgaaaagtcattatagttattatttttgattggttcatcttttcctctttctaaatatatgtctaaattcaaactctctgattcacacagctcacaacagacaacataccataccaccctctggggtgtggtagctctaattcccccaaatcatcaatcttccacctttcctgcacttgtaaaggatgtattaaatccccagaatgtgtgtgtgaactgtaaatagttgtgacatcattttccatccctcagaaacctaggcttcaaacaatttggtgatctttaggcaacattagtataaaatcagtctatatatagagagagcagaaagaatcagtttttttaaataaaccaaataaattgtattattgattattttcatgatgcaattaaactatattattaaacaattaaaatgctcaaagttcttaaatgggcacaggaatttctataatagataaactttcttttcagaaatatacattgcaaaaattaacaacttttagtagtttatctagtcagtacatttttattggctcaaactgttaagtctgtcaaacactgagaaatgagcattttgtctacgttcaattcagattttgctgggaacttaagtatatttactttttatgtggtatttgaccatgaaaatttgtttggctaaccctgatttttttattcaccttcagctttatgttagtaaagggatatatgaatatgatgaaacaaatggaatataaagtatttccatatagtgctcacaagaccaaatatatttctttctcatttttctttttgtacaaagtaaattagtctggttttgcatcccaatgcatagggccaaaaatgtatgtctacatgaggtaagaatttaagaaggaagtcaagagaaattagaaaacatcttgagataaatgaaaataaaaagacaacattacaaaagcagtactaagtggaaaatttacacctataaaagcttacactaaaaaagaggaagaaagagctcaaataaactacccaattttatatcttatgtagctagaagaaggagtgcaaactaaacccaaagctggcacaaggcaggaaattataaaaattggagcaaagataaacaaaatagagaaaaagtaatttaaaaattagcaaagtaatagttggttttttgataagtttttaaaaattgtcaaacccctaactagattgattaagaaaaaagagagaagactcaaagaacaaaaatcagaaacaaaagaggagacattagagctgatgctatagaaataaaaaagataagagacaattagaacaattaaatgtcaacaaatttaatattgtacaggaaatggataaatttctagaaacatatacataaaatctgctaaggctgaatcgtgaagaaacaaaaaaatctaagcagacctataactggtaaggagactaaatcaataagtaaaaacttctgaacaaagaaaaacccagggacacatggtttcactggagaattctgctgaacatttaaagaaaaatttacactagtctttctcagccctttcataatattgatgaggaaggtactctttcaaactaattttatgagtctagcattatcctcatatcaaagccagacaaggacatgacacaaaaactactaaagaccaacatccctactgatattgatgcaaaagttcttaacaaaaaacttggaactcagatttaatagcacattaaaaggattatgcattatgactaattgggatttactcctggtatacaaagatggttcaacatttttttaaaaaaacccagtgaatgtcatatacttcattaacagaacgaagggagagaaactgtaatagtctcaattgatgctgaaaaagcattttacaacattcaaaatcctttcatgataaaaacactcaactagaaatagaaggaaattatttcaacgtgataaagactattatatgaaaatcccacagctaacatcatattcagtggtgaaaaactaaaaacttttactctaagatcagaaacaaagcaataattccactctcaccacttctatttaatgtagtacttgaagtcctagccagaggaattgataagaaaatgaaataaaaggcatacaaattggaaaggaagaagtaaaatgatctctggtggcagacagaatgatcttatatgtagaaaatcctaaagattacaaacacacacagggatacacacacattgttagaacttataaatgaaatgagtaaagttaattaaaatgtacttcctgcttccagcctgttgtgcaggtcacaatctcctgactaacactccttacccacactacgaagtggagctggaaaaactcagtgtggaagtgcagtggtagtttaaatcagcaggaaatcttatagttgatagtgtgtgaaatggctttgtcaacagtaaatttccagtttcacaggttcattacgaatatcagataataatgtctgcctgtataatttgaaaatatattcatcatcacattagtcaaatagagagctcaggtgtattttaagaacttgttagagaattctacattgtcaactgacagtcagaggctttttcatgcaagcgtatggatgttggtagaatttgggagatgttactgtaacctgcacaattttgtatttgaggtcattaatgaggaggtttgtgtgcatgtgtgtgtgtgtgtgtgtacgttggttgctcaggcagctggaagggacatcaatttgggagggtttcttgaatcattgtttcagatttcctagccaatgctttagtgtgcttccctgtaaattggaggggagggtcttagtaatattttagtagatttttgtcctttttcttttctcgatgactgcttctgggtggaccaggttaggagcaagggaaaggcttggcaactattgaatctctgtttctttatttgattgccttacatatttcaattattatgatcctttctagtcatggaatgctgtagaagattaggtataatatatatatgtatatatatgcatacacagacatacatatagacacatgcatgcatataacttatacatatatgcataattttacttacttttgttcattttgttacatggttatttttagtgtgaaaagattgtcctagctaactgtgctgtcactttgccctgaaaatctctgcagccatatcaagagctattgactttatgcatagttgactctagaacaatacaggagttagaggctgactcccctcaaagtgaaaaatctgcatataacttttgactttccgaaaacttaactactaatagcttactgtcaactgaaagccttatcaataacataaaccatcaattaacacatattttgtatgttatacataatatatattctcacaataaagcaagctagaaaaaagaaaaggagatcacaagaaagagaaaatatatttattattcattaagtggaaatggatcatcatcaaggtcatcatcacactaagctgcgaagcaggaggaggaaggggaggggttggtcttgctgtcttgagaggtggcagaagtggaagtaaatccacttataagtgggccctagtagttcaaacctgtgtttttcaagggtcaactccatgttcaaaagaattggagaacagaggcagtgctggcagcagcagagctgggggtaagagctgatccactgcagcactgagccactcatccactctgggctaagtctctctcaggctctggcctttagccgctgaaggcacattctcacttgggaagaggatgaggagaaacttgggtcgcaactatgttggtcacaaatgtctttgcggaatcagcgcagtgtcagcaggaagcagttgaatttgaaggcagatacaccttgactcttcctgcctgccaatgccctgcctcgcagtagacaagtctccatagatgaccagccaagcacagaagtgcagtaatagagggacctgcagtaccaacactgcccacacatctatacttcacaagccggtaaagacatccagtagctcattgtggattcgtttaggtgcattgaagttcttagtcctctaggaggagattgcaccagtcatatgatgctcattcgcttaataaacaaaagtgaacatcaagatctgtgaagatgttcctagagccagcagcagcttgagaacttggaatgtaagaaactccccaaaatctggtattctgggctcttgactgcacagatagaatttgtcaaatttgttaaaaattacaaccgtgttgtttacatagaattattttgacagttaagttcacccaaatatcgatattgtgtaaaagtgtgtgcccactatagatgtcatgatcccctcctccaaagttgtgtgggctgtcaggacagatcaagtactcccaagtcaccctagtggagccccatatttaaagggaacctctgctctactcacccagtgcctcattcctccccctaattctcctctaatcctactagaaactaggttataaaccaatcttctgtcaccagcactagtgcagtccaggctcccccaagaagtctgggagtttggagtgcatctcaacattacgtccagaaacaaagggtgactttcacactagtttagcatcccccacgtgcagagtgctgagatgggccgactggagagaggagactacaactcttaaccctcctggcctcaggttctgcctgttctgtggaaagaagaaaaaaataatggttctgccccgtgctcaaatttgttccttgccagttgtggccttcaggcaaatctcttctcttccccgagcctcatgcgccccacaaccttctgagacacaatttagaaaatatgaatgctaatagtgagtgtaaaatcaccgcaaagtgttatgtggacgttagtggttattcttcaacacatctaattgtgttgaactggactacttttccagctttgccgttatttttcatagggttgtttgttgatttaaaagtgtgattctcgcttgaaccagggaggcggaggttgccgtgagccgagatcgcgccacggcactccagcctgggcacggagccagactccatctcaaaaaaaagtgtgattctgcagccatagttcatagcctggatcccagctctgaccttgtaaaatagcctaaacgtgtgttccctagtttcctcatctttgatgtggggacaattatagtatttttttccataggattattgtaaggattaaatgagtaaatacacacaaaaggcatcaaagtatgcctactaaaagtaattaggactgttagaagtcagagtagctaccctcagggaagaaacaagaaagcgggttttaagtagtgacgagaaggcaacactcaggaggcttctaggtcctgagcaaaatcttttatttttcacacaggtggtagtttcagagtgcattcagtgtatgaatattcattgtgctatatgcctaagatacttgcaatttctgtgtattatactttttcttttcttttttgtttttaagatggaatctcactctgttgccctggtgggagtgcagtagcatgatcataactcactgcagtctcaaactcctgggctcaagcaatcctcctgcctcttacctcagcctcctgattagctggggttacaggcatgtgatagcacatctggctctgttattttcatggtaaaaaaataccacaatatgtgtaattatatatatttgtctgctatggtatatagatttgtctgctatggctgtgtcccatttggccctctaaaaagttgttcatgcttgtcctctaaaaaagacaagattcagctttttgagaatctgttccattatggctaaatgttttcaaaaaactggttttgtaaaaatgttctaatgaagagttgattcattgtgacatcctcttttattccaaagaatccttttaaaattttccatgcatacgttttatcagtaatacaatgtaatcaaatattagcacctcaaaaatatattcaaagacttgtaaaactcaaacaaaacttgtgaccatgaagttttgatgtttcatcatgtttcctaaaatagaaagtttacaaaatctttcaatctcctaagttactagatgatgcttacagaagcaataaaatcagagaaacaaaaatgttagaaaattcttgcaggtgattttcaatattgttttattttgtgcaaaaaataattaaccttttagaaggtcccagagtattagaagcccaaactctggaatattctcaattttagttgagcttttcagttattataatattggtatagctactcatataattagtaatacaaaagattctgagtcttatttgtaaataaagttcaaaataagtcatatgttataggtaatcatgttagatataaaccactattgaaaaagaatataaaaacaaaatactttattttttgattatacaatatatatagtccattatgttcacatttagaatgatgttaacaattgttttgacatttttaaaatgaaaaacttcaatatatctagttcatgaaattgttaataaactagaaaatgatatggacataaaaatgacattagccaagtatatgataatgaggcaatggtggcaggtgtacacaaaggcataaaagccattatttcccacccaaaatgattatgtcacatttgtgccttactcagctcataatcttatgtaaaaatctgcatttgtgaattaagataactttttaaaagtattgtacaaagggtatatctacatttttgaattcaactagcagatgggaaattatcatgtctgtattaaccactacattaaaaacacttaaggatatctagggcataaaaataaaaatcgatgtattggcacttaagatatgtattaagcagtaaatgataccaaatgcaaacctgcattatgctgaaatggaaagcatcttaatgcaaagagattacacatttttatgcaacttatctatgtgggatgacattttgaaccaagtggaaaatgttaataaaattctccaatgaaaaccatgactatacagcatataaagctgaatgcttcatagaaagcccttgcttaaaacaactaggatttaaaagttcctataagtggaaattaaggaagacagttattggttcatgagatattgccaaacatggtaatgttcttaattgaaaatgagtaagcagaaaagtaattttgaaaatattctgatgtttgcctacattaaaatcagaaacttacaaaaaaaaaaaaaaaagtctggtcttggcatatttaaacttaaaataatgtgttttaatagttttcagttttttcaactactttgttgtaggaaaaaataaccattaaaacttaataaaatcacctacattggggcacacattttccttttcccccggggtgccctgtccactgaaaggtggacagcactttgtaagctcgcttcctgattgttcatgattttcccctttctccgaattcgggtctttctccgcagaaatggccctgaatctctaacactgactacggcacgatctgattttgagccgtcagtcccctcaatacactggcacattggtaaaacggtctcgctaaaatgttccatgagaaaaatgtctcgggggaggcggcggtagagctctccctctgtagtcagagccgtgaaaggcggcgtttactcgctgctcacgaggcctgcggaccctaatccccaagcgcccgggcctccactctgcggaccccaagcgcgggtctccttgaggaaggggcgaccgcgggttagggtcgctggtgggtccgttaccgctggtccggcgccctctgtcggctgtttgtaacagcaaaggcagctttgtgcgctgttagcagtggtcgcgtgctcagtgtcactgctgtgctggtgattgaaattctccgtgtcctgatctctgctgatgccactcctcacctgctctgctctcctccatccttcacatttcactcatcagcatatgtcatcttctattttcccaatcatttcccatagtcatgtaaattggaagcataagtatcctctcctttccacccacaagagccactagctctgttttctacaggagtcactgaaataattgtaagaaactcactctctggtccagaggtcataagtctcacaggtcttgtctcccacgcacctcgtgaacttacggtgagaattaactgagcaacatatagagccacctgggccatagtaaatatggttattttataccaataattatgatgattattaactttgttgattacgctttagactctcagagataattaccaactgttaatttcattttgccaactatataaaatggtcaagatatttccttgtcattttgtcaacacatctacatatttgtaggtgaggcacacattggtgaaagtatctgataatttgtaatcaatttgagaattgtagaccataaaggaacatcagtgtattataagtaaagtggaaggctttctagaaaataagtgatgattcagtacatgcagtttgcacagacacgtaatgctgtgggtgaggaggtggagtttggagtctgacaaaatctaggttttgaaacctagatttgccttttatttactagattgttttagttacatacactccgttagcatgcagttttttggtaaatgagattatagtgaggggattaaatgagtccctcagagaggggaaaataatttgtagttgctatcatcatcatcaccatttttgataaagactgaaagaagcctgtgtgatttgtctgtcaggcccttggtggtcatgatcagagcaacattgaaacatttaattagtaatcaattcaggattaatgtgccataagaaaatataggcagcagcaaggaatgtgttctttattctcaaacaaatgtagagaataaaaactattttaatgaaaccttgccatataaccatgataacctgaggtctcttcgtcatgaaatcattcatgtagcacctgtaatacattggttagattgtgacccaatatttcaagtttaaatcatatatgacagacaaaattatcaagtataattattaaccctttctctaaaaagaggatctcatatctatactcacaagtaaaatcacagatattgaatcaaggagaggagagaaatgatggcctgaagttggccccatttaagaaaggcacacgggtatgaatgagagaaagaaacccacaagaagtagaaggaggctacaagaaagaatatgcaggtgtttggggaaaaaaaccacatttgctcagaaggagctaccatgataagagtgactcatggagtgaatggttaaagaacatttaatttttatttctagctaagttgtccaggtctagctaagttgcccaggctggagtgcagtggcatgatcacagtccatggcaggcttgaactcctgggctcaagctatcctcctgcctttttcaaaaaacataagtaaaactgaattagttccagctagtaaaactgccaaagtgtttggtgcatcttcttcatagccctagaaagggttcctaccgattacttactctataagacctgtcagctttgccagagtgctccactacagaaataatacatttgtcttacttaccaatatactcactaaataagtacattacttgaaacagatatactcaaaatattttatgaagcaatgaaataaataaaaccatttatgttctttttgaaattgatggcagattaaaggtttatggacattttgtatcttttcaagagtatgagttaagacccaacatttacagttaagatttaactccctcctacactccacagcaaaaacaaacaaacaaaaaaaggcaagctgaccgtgtttataaagaataaaatttgaagacaagtatcatgagataaattgtaattgttacaaactaaaaatgtactttccttatattcaaaagtactatacaatttcttcttattgaaaaaggctaacaaaaatgactcaatacattttattacagaagcagaaggaaagtctttgaattgagcttaaagcaacaaattaatagatgagacccaactgaccaaaatgaggtttacgtctaagtctcttctccaaacttctgagttttctgataagcctattagcacagagaaataacttactgatttttacttcttaatttctggtaggacaatgtcctgggcacagcagctatgtactttctttttcagctagagactggtcctttgggaataacccatcacagccaggctggagttctacccaaggtctcttccatttcctgttccaaacagttctccagaaattctagctactgaccaagcccagtgaggaatttcagccctttgtgctgaaaacattggagatctgctggatcatctcatggagaatattggtggcctgagccttttggaatttggtgccatccatctgctccaggagaacctgaaaacattcttgtccttcagacaggaagaaaaggaagattcttccatttggtgaagaactgtgaaggtctcctgcttctggcaggctgggccaggtcacagctaagggtacagagaaagctggagaacatcatcctcagtgtcactagtgaaaaggttggcagggccactggtgggatgcagctggccgggccttgtgagccttcactcagctgtctcagcactttcttgttgtgagactattacattaccaggcaaggattttcagtttttgtacttatctcaattttttttccattttgttcactttctattctatttatggatctcagataatgtcatgacctcagcacttcttttgtattataatggaaattaaacactccgaaaatgaaagaaatcgcgatctaacaggatgtattcatccgaatgagaatgtttagtttaaataaaaacctgtctgagtctcaatctatttctcttaaaattctaataatgatgcttagaggttttatcttagatgtcatttttactttcttttcttttttttctttcctttttttttttttttttttttgagatacagtctctctctgtcacccaggctggagtgcaatggtgcgatctctgctcactgcaacctctgcctcctgggttcaagcaattctcctgcctcagcctcccaagtagctgggattacaggaacctgccaccatgcctggctaatttttctgtatttttagtagagacaggttttcaccatgttggccaggctggtttcgaactcctcgcctcaagtgatctgcctgcctcggcctcccaagtgctaggattacaggcgtgagccactgtgcctggcccatttttacatattaaactgcactgaaatacacatttcctcacctctctccatttcccttttaaggggctaatgcactagatttgatttcttccacctttctttacaggagccacagatcacaatctacagatcacagggcataaaactggcataccaacggttaactcatccagttgtcttcattctgtcactaaaaatgtgttcactgcatatacgggacaaacaatgtgcttggcaatgtgggttcaaggataataagacaggatgatgattgccctccagggagcaaaagccagacattaaagacacgattatgattaattaagcactagcattctcagtgctgccaagaggaagtactgagagcaaatcaagaggggagttggaggcagtagaaagctccactttctgacaaaatctgtgactcttagcaagttaaacatcagattttcatttcctcttctgaaaaattcagaatattttagtagttgtcatattagaaactgtaaagattaaatgaaataaagtttggaaattactggctgagaatctgaacatgataaattatagtgatgtggtttggctgtgtctccacccaaatctcaccttgaattgtaataattcccacatgtcaatagtggggccaggtggagataattgaatcatgggggcagtttctcccatattgttctcgtggtagcgaataagtctcacaagatccaatggttttataaatgggggttctcctccctgcacaagctctctcttgcctgccaccatgtaagacatgactttgctcctcattcaccttccgccatgattgtgaggcctccccagccatgtggaactgtgagtcaattaaacctctttcctttataaattactcagtcttgggtatgtctttagtagcagcatgagaacagactaatacagatagtaacctttagtataatctatatagtttgcatttgtgaactatatagaaaaaatatatatatacatacaaccatgtatttataatctgtatagtccatattcaaccaagtccatccaagaaaagctttgattgcagctcccctgacactctcagggtcttgcacattggcgcctcctaaatggaaactctaggagaggaaattgtctgtaagactggaaaatattttaaagaagtttattctgagccaatatgagtgaccatatcctggagaaacagttttaagaggtcctgaaaaagtgcacccaaggtggttgggttataatttggttttagacatttcagggagatacgaattgcaggtaaaatcataaatcaatacatggaaggtatacagtggtttggccagaaaaggcaagacatctcaaagtggggatttaaaagtcacaggtgggtttcagggattctttagctggcaattggttgaaacagttaagctttgtctaaagacttgaagtcattagaaaagaatgcttaaattaagataaatgggtctgcaatctgccatatggtattatatgagagttaggttagaaagtgagccacattttactgggttaatttttaaaaatccatttaaggagattttatggtttgcagtacataactctcgccttgcatggccttaggtcttgcttataatttggtatcttattgccacaaagtctgttttgtcttattatctctcttataacatcaatgctggccagtttgtgtccatactccaaaacggagggggatataatgaggcgtgtccatcctgcttcccatcatggttgagaattcagttaaggtttttaggggttccattggccaaaagggggcatgttcagccaatgggtggcttagtattttatttttagttttagtttataactctatatctatatatatatgtaagtatatgtagaatatatacttacattttatatattatgggtatttaaatatataaatatatacatatgttataattttatataaagtatatgctgaaatatataaatatgtatacgtaagtatttaaatgtacagaaacacacatataaaatagatcaatataaaaatatatatcctttatatatttaaaatatatacttaaattatcaactcaaatactattttaatacaatattaaaattggaaattaatgcctaaacatccatgatgaggcaaatatcaaaattttaattaagtaaaggcaggaaatgtaagatgaccctgagggtcttacaaaggagaggggccagtgtaacaaattatggcaaactccactcaggctataaaattcttaccctagaaaataaaaagttctgacctgctcctctactctttgtaggcaacactgctcatttctcttttcagcaacacaagtcaaggtggggtcttgaggaagggctttcagtaaaccaaagttaaataaaattatctcagtgtcactgagtcactggaaatgtcagacatggcacttctcccagataaaacaaagtagggatcttgaaagcattgctgagtttgcttcctttaaagctagggaagtaagatcacaacattcttgttttggtataaagtatttaaaataatgctgttgagttttaacatacctgaattatggtttcagcgacactggcgtctgaagctgaaagcttagctcctggcacaccctggggcaggcacgggcgcctctctgctcctggcccggtgcgcggcgtccccagccccgggcgctcccaggacccgtccgctcgccccagggtccagcgtgtccccttccccaagacgtccccgccctgcgcccccacacaaacggaatccccaagattaaacccgtgcgatctcgagccctcaagtcccggaatcaacgggtccctctgtaaaaacaagtctcgctgaagtctctatgggaaataaaagccccaaacccaggggaaaatcccgaaaataaaaggtgccctgctggctacctgaggaagatgtctcaagggagaccacggcggagctgcctcctgagcagcaaaagagatttttttactcaggtcgaagctgcacaaagttggcgcgataagccgcgacgacgtttccctggggctgcgggacgccccgaaactcaaacccgcggttcccaaatcctgggcatcaggaaaacccattctggcgccttgctgcggccgtggtgcgcagcgctgggagctttgcgctctttgcgcagcgggcccgcgccccttcgaggccggctagtgaatctctgaaatcacagtggcctacacctccctggtaatggcgggagtcatcatgctcatctccagcgctgcctgctcacttggcagggacaagtcttggagccatggctagaaaacaaggaaggcaggaggaaacctcagtgctattcacacagctgaaaagtatcccctctcaatcatgcctaatgacagaacccacttcaagttttctaggaaacgaggaactatcacccaaatccagaagacaggagacatccgtttccaccgtcagctgctccagcagatcttcagcctcttccccagggacgacacactggctgtttggcataagatcctcctcaataaacgactctccagacttgatcacagtctggaacgactgcagctgacaaaagtacatttctgcaaaagtagaaaatctatcttgtctctatttaggaattgctgtctggaaatatttccaaagaatcattccctatgtgaagtaaagggaataaggcctctgtgcctgggaggttgtcagaggggaaattgaagggtgcttttccctagttaacaatcctcaaagaaaagacagcaaataaacaagaaagttattatatattcatgactctctctaatcaattacattattgttttctgagccaaaaaagcaatgtcatctcagattttttaaccagctagaaaaatctgaaaccaaaatcagtagattatatcaaaattatattgtgtattacaaatttataaaaaatatttgcagaaaagaacacgtattagtttcttaagatgatcatttattattttatttatctgcttaaatctttgaggggtatttgctgtttccaaagttgaaaatttaattttttatggaaaagtttcttcaggatagtattttaaaagactttgtcagttaagttgatgagagctgctgtaacagataaatagaaaacaattagtaattagatcaatatgcaaatttacctttccttcctataaaagctcaatgcaggacttcctgctcagatgactcgggttggctattcagggatctgagtaccttttattttgtggctttgctatcttcaacatataaccccaaatgtggctgtggtgcttcaatctattttagtcaattgcaaaggttaaactgtgtggtacatcacgtggagttgttttcacacgttacagggcaagatacacatcttgccaagatgttacagggcaagaatctcttccaaccaaattaacttggcctggatttattctcacaggataccaagatgcaaagaagttgtgaaagggagtccaattgggtgactagtaggaaaagaaggcaagttctttgaataagattaatcttcatttttataatatttgtacaaatgctatttttggaggaaaaacaaccaatgtttttgctcacatattctattaaaaactctcttccaaaatctgatttcacaattcaaacgcagggaagtggacacagatgtcatttattagagtttatggcatcattgactctttgaaagaaagggttaaactggttcccaaagccattggctaaagttgaaaaaagaccaagagtatgggataaggccttggaacacattgtaaaattgaaattgtttccttattgtctgaggagacaaggaaactatgacaggtatctctgcaggtacttgaagaccactgaaagaaaagtggagagggaattttccatttgtccaagtcattttttctcattcagatattctaattattaaaaatacaaacttgaaaatgattctacaagcaagtggctgttctttctttgaatattccacataattttcaatgataacttccaatgaagaaccttgaagaatttacaaattatcttttgatgtattttcctttcaaattatgtatctaatatgtattggtaatattctttccactggttttatagtgattactctttttcatgaatattggctgagctcctgaaatgatagggactgggccaagatgccagggaaaaagactagataagatgacgtgtctgcccataagtatcttatggagtcctgataaaatattctaaagagaaaataggtcagatcactaaaggcaacatctcagacagcaaaaaaagagaaaattataaccatgcctaagggagaataagaacactaccaggcaaaaacatctgaccaaggactcaaaatccaaaatcacggttttttcacctgaagtagcactttgaatattacatgccaaattttggaaatcaaacagaaatggacctcactatcacatggaaaatggatggagataacaagaagcaaatggtcattcatctattttttgtacaaggagaatcttaaaaaatcactggataaggcgacataattatcacattatttaagacacacttaaaaaaatggaaggccaaacggaaggagtaaaggcatagtttgctccaattctaggcctgtttttagcaagtatctttccacctatgcaaacacgttatttttttccaaccccatttctttagttctctccatatattgcccatcatgtttgcccggtttctcaaaacaagtggtaaaattaactcagcagcaaactctgctggcctgcaacataaaaggcatcaaccagctggcaagtcaggtgactcagagactttggtatcacagtcctcctcctataatacactggactctcctcatttctccagaagaccttccattcccacttttaatccttttagtgagcccttctagatgtggtctccctgagctctgagccttagttcattggtttagttctgatttagctcatgtctctagcttgtcattgcttagtcttaaacttgggctaagatagaaatctaaggccttacggatatttgaataaaaggatagaaatatgcaggtttttacggagttgtttatggatatattactagggtgaacaaagagttttgcaactacattcaagtttatgaatatacattctcaaaaaaacaaaactagtatataacatgtaaataaattggggcccatctttattataatgtaacatatcaggcataaacaaatagggcttttcagtgagggagagggtgaaggagctgaaaagaaaggccgtgaccttctttatgtagaactgtactaagaaaacattgaccggggtctagaaaccagctctgggtcttatggccagaaataattcccagggaacatgtaagaaatgaggatttagagtcagatgttttgggttccaactgtagctccacaactcaatagctccctgtgcttctgggttttccttttgtaaaaaaggacaacagtacaacctgtcagtgtctgctttggtcactgatatctctagcaactaagtagggatgggcatatagtagatgttcaataaaaatgaaaatgagggtatttctcattgaatgaagtgaaaatagtttttgtaagtgctaagaacaatatctgattgatagcaaacatgataaaatttagcaactttttattcttcttattagtgttatcattattgtccttttaagtcaagataagtttcctttgagatcatctattccctggcttcttgttagatagatatattagtcagagttctccagagggacagaactaagaagatatgtttatatataagagggagtttattaaggagaattgactcacacggtcacaaggtaaagtcccaccataggctgtctgcaggttgaggagcaaggaagccagtggtggatcagtccgtgtcccaaaacctcccaagtagagaagtcaacagtgcagcctttagtctgtggccaaaggcctgagacccccttccaaatcactggtgtaagtccaagagttcaaaagctgaagaacttggagtctgatttcaaaggcaggaagcatccatcagaaagatgaaggccagaatactcagcaagtctcctcttccatcttctcctccctacttaattctagccatgctggcagctgattagatggtgcccacagtgactgagtgtgggtctgcctctcgcagttcactgactcaaattttaatctcctttggcaataccctcacagacacacctaggaacaacactttgcatccttcaattcaatcaggataacactcaatgttaaccatcacaacagataacatgcaatatactgatcttctgagtttatctgtctactagtggagaacttgagataattatacttgtccattctacagacagaatattgtgctcttacaaatttgcctttctggtgcacagtgtcttatgtttggttcatcaccctcaactgtctagtaaggctgaattcactaaagctgaaaacatccccttggaccagtaatgattacttttctttgagctcctgcccatttgctacctttgttctacatctcttgcaccattttgcttctgctcttcctcaccccttaatgtccatctaatctgggctgaatatccaagttatattttgttagttgtttttctcctttgggatgttacttccattcttatgtttttatcacatttagttatacatttgttttctttttgctctcatttattgggatacaaaaagcaacaacttttgctttctgtgaaaaaggaaatgagaaagatatctggtatcctgcatgctatgtacaacaattgcacacctcatttactttatcatacttagatattattatttaccttaggaaacagatggctttttttattttataagaatgaactagaattgggatgtccccaggttctttgggaaatctaaacattaatgcaaaaattgttttgaaaaatataattgatgttttctcaattgtgtattctcattggggatgatattgctcctaagggcacaaaccttagttcttgtggtgtgaacaaattgtagatattatattcgtttatggcccctcaatgcagaactctaagacaaccctatcctgtagtgtttattttctttcacttggttttcttatgtattacatgaaaagactgatattgagttcatggaagatacacaaaatgtatgtgagattagtgttgcaaaccaatgtgaaatagatggttgtcactggtggactttccactatgtgctcaatctcagagtcataccatgtgatgtggtctccatcggcatatgaatgggctgccattggctgtcttgggtatgtagcttatgtttgatcctcagtgctttcaagtgtattatactcttttatacaaatgtttttattttatgattaaattgtataaaactttttcaaacatcactacttataggaagtgctgaaaagaaaaatatgttgactatatctggatgaaaatctagcagttagtgaaggtaaaaatcattttctatatgaagcaaagctaaaagttaagtataataaattaaatgttacaggaataatttaattttaaatagccccttagcagttttgggagatttttaagtatttttatttttttgatattacatattttatataagtatttttattatattggtattatatattttcatatattataactttgcatgtttcacttgattcattaatatttatataagtatatatactagaagtcactcagcaaataacttttataaagttaaatgccaatagcttttaaatttaacttttgacataaaatttttacttattcttaatgctgcattgcataaaaaagtaaactgtccactttgttttctaaagcatggataggaatgtagtacattcaaatatgtgcataatatatctgtgttattaaattatcaggaggggtttacttagaaaaaaattatcaaacaggactctggaggttgagaaagggaatgcagtaatgaaaagaaaactggttgagaaacactttcctaagcccatgtagagagtacataaaggaaagcaaaaacagaagtagaaaaaaaaaatgcagtagcattcagaaaatggaaacaaatatgttccctatataaggcggtgtacaaaccaaagtcttcagagacccaggttaagggtcatccatctgaaccagctcagcagcatccacaacatctacaatggccttgactttttatttactggtggccctagtggtgctcagctacaagtcattcagctctctgggctgtgatctgcctcagactcacagcctgggtaacaggagggccttgatactcctggcacaaatgcgaagaatctctcctttctcctgcctgaaggacagacatgactttgaattcccccaggaggagtttgatgataaacagttccagaaggctcaagccatctctgtcctccatgagatgatccagcagaccttcaacctcttcagcacaaaggactcatctgctgctttggatgagacccttctagatgaattctacatcgaacttgaccagcagctgaatgacctggagtcctgtgtgatgcaggaagtgggggtgatagagtctcccctgatgtacgaggactccatcctggctgtgaggaaatacttccaaagaatcactctatatctgacagagaagaaatacagctcttgtgcctgggaggttgtcagagcagaaatcatgagatccttctctttatcaatcaacttgcaaaaaagattgaagagtaaggaatgagacctggtacaacacggaaatgattcttatagactaatacagcagctcacacttcgacaagttgtgctctttcaaagacccttgtttctgccaaaaccatgctatgaattgaatcaaatgtgtcaagtgttttcaggagtgttaagcaacatcctgttcagctgtatgggcactagtcccttacagatgaccatgctgatggatctattcatctatttatttaaatctttatttagttaactatctatagggcttaaattagttttgttcatattatattatgtgaacttttacattgtgaattgtgtaacaaaaacatgttctttatatttattattttgccttgtttattaaatttttactatagaaaaattctttatttattctttaaaattgaactccaaccctgattgtgcaaactgattaaagaatggatggtacaattcctttatccatgcttattacattcaaattataagtaaaaatgaactttgtctaaattaggttgtatgttgccctcaagatatccaggtgaacataacaaatacaattcccgctctctcatatctttgttttttgttgggaaagaaaactaaaaacagtaatcatacttaatatcagttatgtctaatgctatcatgagaagaaagaaccaatgaatttatctcaccagaaggtagaccaaggcatgtgaggaaataaaaataaacgcagagatatcctctatatgctaactggtagacatctaagtgaaaatgtgcactaccagttggatatatgagtttgcaattaataaggaatgcaattgctagaggttcatatgcagtaactgaaagcccagaaatggaggatctcatgtggggagagagtgtcgagggagaaaatggcttaaacgtgattctgaggaccttccacacttaagaaaggaaagagaagagccacaaagaaacagatggaaaggccacacattagaaggacaacaggagaaaatactaggaaaaaaagtttaagaaaattaatattcttaaaagagttatcagtagatttacagaagatatacattgaaactgtccactacctcgggaaaatagatggcactggcaaccttatgagagttattatggtaaaataaatcagaacaaaccatactgtagtggctggaagtataaataagagaagttagtgactctgaagagggcaaaaaaataggatgtgatgggggaaagaatgtgagttactttttctgtgcatagtatttcctttattaatatttttctggatagatttcatgtaactgatgtactagcaaatcatattaatatacttaatatattattttaaatcatgatatattatttacaattataatttattattgttttaattaatactactttggctatcagtaagctacctagtttctgttcatctgttagggagtaagagataactaattcgatccttcaccgaaataattaatgatgataatataatgacacctggaagtattggccttatttgttgttaacttgcatcattgtcacactggtttactacagttcttctgcacctttacaatccatcttaatttcttgtagtgctagatataagaattcttttatgttacactttggtaattcttcctgatttcatgaatattgtagtcttagatcaatccagaaagaaccgaattactatggacataaagactgacaaacatccttcacaaaataaaagtgggaaacaatcagagactttctttctcaatacgtaaggtaaagaaaaaaactggtcaacatcaagtgaaaatacatgaaccacgcatattcagagagcaaggaagagttatgtataattcatgaataaaaggagatttagcaattatgacagaaatctggaatacaaaactgacaaaatcacccatcaattacattaaagaatttgatactgaaatttcattctgctgggaggtaggtgtattgttgatcattctgcttaatctctttgagccttagttttctcatagagccttagttttctcataaataaaatggtttcaaaatatttatatagttgtgagtattaaaggaacacatgcattttaaagcacctacgataatatcttttatcgaataaggagttaaactatggtaggtattttcctatttttcttcatacagctgtagatggtaatattatttgtctttttataaaattcttaggaactatgtcctatattttagtaacggacctccaatggaaggagattaagaaaatgagaattctagagaggctgaaaaattgtcaatcctcatttcaaagatgtgtcctatttatatgcagtcagggaatggtggctgctccttttcctgagataggagaagaagcatctagtttgaactgcagaagacacatgatgtttattgactgattctggcacctggtacattccttccctggctctcagcattccaggatgcagtctcatatcaccagggtttccttgatcattcactccctttatccttctgcccattcacacagagctgctttctgttctgttgtggttctggcttcatggtttccctaaatagcagaaaagtaaaagtagaaagcagaagttaaataaaaaagacagtcccctgggaccaagtgtaacaagagcagcaaccaagactggagggcaggtttctgatctatggagaaatcctaccagttctggagatttctctttgtgctgcaaaaaagctacttattggcgagaagagacgctaatgttgtccaagtttgttccttatccctggtctattacaaagagaatgagtttccaggtacagtcaaggcatggactccttgggattcgcagtgatagggacacagagatgtaatatctgcccaccctactgtgcagaacagtctactccccaggatcaccccatcctcatacattgggactccagggcacaggtagggctgccgttttgtattggaacttaatactattcacagaaacctcatgtttaatggtgcattaaaccagcagtacaatcttaatttcacagatttaatcctaatatcagagttcaaacattaacaaattaaaacattttctcactgtcattttgaataatgatctttccagttcttccactcaacagtaaaacccctgcccagttagaaaaaggaagaattcccatagaagctaaggaatgtgaaagaatagcattactgttccctgagagctggcgaggtctatttattcaaatgtatcaattttggtagagattgagaggcattcctataattgacaccatatattctggagttatttcactaggaagtgtgtgtgaattgctgaggtagcagggagggagagcctacaactgcacaggggcctcttgagtcttttcctccagctacacactcaacatctggatttgctgctttcagactgggagttgaccagggccttagacaaattacaaaaaattgtattgtttgcagtcttcttctgtcctctagaggggaggatggagaaatttaggagtgaccaacggggaggtaattgaatcatgggggtcggtctttcccatggtgttctcgtgatagtgaataagtctcatgagatctgatgggtttatcaagggtttctccttttgctaattcctcatttttctcttgccagcaccatgcaagaagtgcctttcacctcctgccgtgattctgaggcctccccagccatgtggaactaactgtaagtccaattaaaccttttgttcctagtttcaggtatgtctttattagcagcatgaaaacaaagtaatacatcttccctctcctttctttaagcagaaggaagggtctcatttggagttctgaactgtgcttcctggggttacgggagaagtgttgcaagtactcctttaacctttgttgctggtgtctcagtaggtcacacgcccccttcctgttcgctgcctctgaacccagctcagcactaggagttgcttagaaattacagtccttgtggcctaggctgcctttcaagtttatttagcgtcccagagccctttagtccatggtggggaggtttgctggaactcaatctcccatcactgggataggacatttccctctggctagggctggttcaaatgctccctctatgggcaggcacagctgagtacagccctgtgctgctttctgctgtcagagggcagccatgaatttaaggcaaagtctcacacgtactgtactctccctctcccaagtgcacagattctccatgccatgtggctgctgctagggatggaggcagggtggggatggcaattcaagactgtctttcctaccctctccagtgcctcttttagtgatatagagttaaaatcagacactgtgagtgttcacaagatttttggttcctatgaagatgctccctttgcatagacagttgtcaaacttgatgttcctaccgagagggtgggaccatcgatggtgccctccattcagccaccttgctctaccctccataatgtctttcaaatgttataacctctttcatttttttcaatgctttaaaaaaattatattcaggttgttgtaaaagttttatgacttggctccaaactgtcaccttgccctggaaatctctatagccatatcttgcatcatatcctggagttattaaccagttatgtgttctacagtagtcaggaatcaagcagtgggtctggaggaccaggacagagagtgaagttggagggcagtgagtgctgagatgccccacccattcaggtccctctgtagtgccaaacattacttccccctacactcccaacccagctgaggtgcatctagtttacctgagaagggccacagggagcatggagaagcactccagttcccatggagacttggcaagggctaaccatgcagcactagctggagacagctaagtttttagagccttggaagcaagagtgtgaatatgaccttgttttgacccctcctgccaggtgattcatgagctgtggggggtccagacccactgatgtccagtcaggccacaaaatgcagtaaatggaaggaggccttcccccatacttatgacccaaagaactggtaaagaatgcaggagctcatctgttcttatgtttagaagtttccatgttctgattcccctaagaggagactgcaccagacataggactctcatttgtttaaaaacaaacaaacaaaacaaaacaaaaaaaaacagaatacatcacaacacaaagaagttgaaaaaaagaggagcagtctgatatcttggaaggagaatagagatgtttaaaacattgactgcaacagtggcaggtcctcaagagatggaactacgtgaatgagcagatggagttaactgttcagatcctctgatcatagagagggagagaagattgaaagtggatgaagactgaagcacagagtcgtctcacagagacatggccaacctcagtgactccagcatgggagacactgatagaccacagtagcctgcagagttttggaagggacaagccttattctagtgccagctgccaactgctgtttcctcttaaggacctagcaagtcatcactccacagggaaaattattccatgaggccagtgcaatctaagacatctcttaaattttggttataatgcagcctcctttaaaactaaaacaaaatgaagcaatacctgaacagaagggacatatcaggtatttgagtataattagaggcaagtagggcagagccttccaagcaggacagatattagtaatgtgcatatttgaagatcataataactaatgatagcaaagacctttgtcaatattcattgaatgaaaatagttgaaaaataaaacattggcagtttgattccctttgttttctttccagttagtacattctgcggtgagtcagcatatttagaatttggaactcttcctgaagattagagtccataaaacaacaacaacaaaaaatcaaatttaaataagtaacaaattagaactatcagccattaatgtattatatagcaccctgtgacagccaattatgaagctagtgatgatgaaatctttagagaatcagacaactacaaacaattcatctcttgttgtataaaaggaaactccaattgtgcctgttaaaggagttataatgagctccgcttgcggtgatttcatgtgaagcaagctacatcctgtactgatggcactagggcaccatcccaactccccagatggccaagacaccttgacagggattattgccagagcatctgggttatagggaaaaaagtgactgttttagatgctaatctgccatgtcactcctgattaaccccaagtctgggaatgcctccaagatatctagttaatgcattactctacgtagaaacacctatttactgtaagtcttacttttcctccataataagccttgacgttgcagaaatcacagactgtgacactcttagcattctctcagccacctacaccttccttccagagcagatatacttttcccccaagatataacccctaggtctagggggctgcagcactgagacctacttgttttgttcctacacaatgacatgtttctgtctgtaagctccccagaaaatcaccctttaccaacaaactaaatttatctgtcttgttctttggtttctgggctcttttggcatttggggaccgctttgcgtatatagccttttcacagaatggggtctttgcacatgttgactgaacgtgcagtctggggacagtggaaaaagctccatgtgactctgtgtgggtcatacatgtttgtgcacacaggtaggcaggccaacaacttggcaatgacaggattttatttcctgattttggtaaatgtttgtaaactaaaaattacatcttttaaatcttaagaaacagaaacactgtagaagcaagaggttgaaaatatcatccattttgatgccaacaattgacaatcctagatagccaaagacagccttactaagcaatgtggctgcttttggagtcaaaggaagactcactttggtaagtagccttttgaaagcattcactgctgtggtgtgggaagtgcataatgtttttccatcttgctcatacaaaatatttttttttggcacttacagctcaactgttggataaaaagataaagagaagaaaaggatcttcagtgggttcatcagtagacaacacaaagtccagtctgaccaggtgggaagaaactgatttgtcatccttgggaatgagaacagcattaaaatggaaaatattaggtgctttttgcttattcaagacaactcaagagtcaaaaataaataggcctctaggagtacgcatttaatgggttcttaaagtggtctaaatatatttcatttaagaaatcgctcattaatttttagacttttttattggcagaaaaatctgctgccttatatccatttagatggtcttttgtttacttttacgaaaaacttaaaagtcagtcagttcaattcactcatagcacacctactcttgccctataaaacaatagacagcaacacatgggcatttgaagtggaacccagaatcccttgacaacttaccctccctgctcttcttatttcatgctatggcctctccttggttcatgaatctcatgtccagttctgtttttttaatggactcctccagactcactattatctcagtttgccctgtggttttgaccttaggtctttgttctattccttcagatttatatttctctccagacagttataaaaatgagtgtaatccaaacatggttattgggtcaacagttttaatgatcttaaaacagtcacaggcctatagttataatgcaataattttggtgttatcttttaaaaaaatcaccattgttataacacaactaggagcagaatcttttgggaaatcaaattctgtttctttgcaggtttctaaatgccatcttttcatttcctgggtggattttttaactaggtacggtgctaaggcaaggctaatattcattatcatgccagagaggactagtgttctagcaactggggtcttgttgccagtctactgtgagttggttggtgtgactcctcctttcttacctcagaggtgataacatctgcattcaatgaaagaagagcaggtggctggtcttgcaaagctgaggacaatccattgacccaggagttgctcttctgtgaggctctggcagaagcagccgtttcccttgcttttgtgtacctcaacaatgacattcatccttcccctgggacagagtccctagtctctaattttgctgcactgaattttgctaacatatgttttgctattttgtcagcagaaagtcacttctcttacttcctgatattcaggcttatatttgttttgtttttaatatataagcaattgttgaggtttgctttctaggaaagttgaaatgagagacaaaaaatctgaaatcttgaaaattatggagaagaacaatatggttcctttgcctttcttttacttttctttatttgttttaattcatcataaataagaatatcatgtaggagaagcaagatacaccttacccagtaaaccactatgtgaaaagaagttacaaaaattcggccagtcatggtggctcaaacctataatctcagcactttgggaggccgaggcaggtggatcatgagatcaggagatcgagaccagcctggccaacatggtgaaaccccgactctactaaaataaaaaaaattagccaggcatggtggtgagcacctgtagtcccagctactcgagaggctgaggcaggggaattgcttgaacccaggaggtgaaggttgcagtgagctgagattgtgccactgcactccagcctggtgactgagactccatctaaaaaaaaaaaaaaaagaagaagaagaagaagttacaaaaattcaacatgaaaaatcacaaacaagtaaggaaataaggctatttctttcttactgaataacctgagcctcactgccctgcattgtcagagtgagacagacacagaaaaagactccattagaatcatgctgactgtataaaataactttaggtcactagtttctgtaaattaggttgtaataaaagaaaatattgttactgaatcccctgtgtccacctcagaaacttcaagcataacaagttttcagtggtttaagtaaaggtcttcatcaataaaaactgtacttcgcaaaataagaattacttgactaaggaaggtaaaatgattgcagttgcataagtcctctacctccttagacaaaacaagcctttgctatcagcattggaggactgttgagacttttgatacctaggaacatggctcaggagaggaagaggccatcactgagggctagggtccctcacacaaacactctagggacaaaggcaagggccttagaagatagattattttggcagcaaagaaacaagacattcctcaggggttgaattctgaagtcatcaggatgtggtgagcctgttttcagggaataaatctgtctggaagattttggattcaggctactttgtgactctataggagagagtgttagtggatgtgataactaccttgtgagtgaggtgatgttggaaaacattatcttggaattagaatctctacacctatatgcacctgaaaaacagccaggattcttcctgagggaattgacacagcctgaggagcacttagtccaccagtaagaaatggtgaaaaaaacagcaatggtctgcattaatcctgactttgtgacccccatgaaccacggcctcatggacctcaataaatgcattttagaaggaagagaaatttcacagaagttcattcaccaatacccatcaatctctgctgtgaataaaacagcaaacaaacccagtcctaaagagtttgaatgccatagatggtctggtatatccctaacttcatacacccatagaggtgagggagtctgatttcctatgtaaagtatggagggtaaaaatagagcctaggatcagggctcaaaatcttttccaagaacagaaaaagcaatgtttatatattaaaaaatagtgtgtgcatgcgtgcatgtgtgtgtgtgatttacatacatatatacgcttaggcctttaggacaaagatgtttctcatgcaattgataaatatccattttgattgacacctctaaagtttactaggaaaattagacttctattgcaaaattaatagtatggagtgatgtttcttcttaggtcatatgaagaataaaaaaataataaaaagggaaataagtgtagaggaatgcagaaaatgaaaactatttgtttcctgttaaaagccatgcatagtgaatgtcttgagagaacctaggttccaaattacactcagaccccagctccaccaggccagcagctccctcatttcccagtggcctgccttcactctctagtggtggtcctagttgtgtgcagctgtggctctttttgatctctgggatgtgacctgactcagaaccatggtctgacaggaaggaagacgttggtgcttctgggccaaatgaaatggatctcccctttcttgtgtctcaaggacagaagagacttcaggtttcccctggagatgtgtatgacagccagttgcagcaggcccaggccctgtctgtcctccatgagatgctgcagcagatcttcagcctcttccacacagagcgctcctctgctgcctggaacacgaccctcctggaccaactccacactggacttcatcagcagctggaacacctggagacctgcttggtgcgggcagtgggagagggagaatctgctgggtgattgggagctctacactggccttgagaaggtacttccagagaatctgtctctacctgaaagagaagaaacagtgactgtgcctgggaagttgtcagagtggaaatcatgagatccttctctatatcaacaaactcacaggaaagattgagaagtaagaatggagacatggagtcatcttaaaataattctcattgactaatctgccatgtcacactttcacatatgatcttggatgttttgctttagttactgaattggttgagttaaattcagcaaatacttcatcagtatattaagcaagtatgtgttcaaaacatttagctccagcggcatgggactctaagagatgactcccctgatgttatttatttatttccactattttgcatctattgtatttataatatttagatattttacatataacatgttaatcttcacattgtattaacatttacaaaatatattcaccattgaatgttattaaattagcagttttgatttgttaaatatttatcaaagaaaattttcattttgtttattctaaaacctaagccaaattgaagaaaggattgcaaaatttaattattcatacattccattcacattatatttatgaactaagtaagtggcagactgtagaaattccttcaagtaatacaggtgactagagcaaacacagtttctgctgtgttggaattctcagtctaagagggaaggagacataaaaaccatactaatgtttatattatttcaattatattaagtgcttcagagagaagtaaaggaaaattatgttctcacaccagaatctttaggtgtaaatgatgctgggaagggaaaaaaaaatggatgtcttcccaaagcgcccaggagacatgaaagtgcagaggtcttattggcagctgggaatgctggcctagaatgaacaaataccatgggcataggtattaatttaagattctttattgcatttctggtaatcagggcatgggaatggatgtgatcacatataaataaggggagaaaattagatgagcactaatctatgttctacagactgtcaatatttaaaggtacagcagagaaggagagtctgcaaaagacaccgggatagagtggccagtgcacttagatgaagaaataaggaagaatgagggagagactaatgaagggaacagtaatgcgttcagggaagatggggactgacctgtcctagtggacctgaaacacactccaccattgattttaggatgatctggttttgcagaatgaatgggacagagaccagatgggagtagtttgaagaagaaacacaagaagtggtattaggtgcactatgtatagaagatcatcttgggaagcttgtttgcggtgttaggaaatagggtgatacctggaggagggtgtgggttaacattgccacgcatatttttcaaatgttttctgagcatcattttcaaagaatagctgaatttgagtaaaacctttaaatatttctttattgagatatgattaaaaatatattatttaaagtgtaaaacatagggattaggtataaatataccttgtgtaatgatttctacacattacataatccacagctaattaacacattcatcacctgacatagttgttttgtttttgtatgcacgctgagaacactaaagatttacttgcgtttaaatctttaatccatcttgatttaatttttgtatgtggtgaaaggtaggggtccagttttattcttctgcatatggctactcagctatcccagaaccatttattgaatagggagtcttttccccattgcttatttttgtcgactttgtagaagatcaaatggctgtaggtgtgtggctctatttatgagttatctattttgtttcattggtctatgtgtctgtttttggttgctgtcatcttatagtatagtttgaagtccagtaatgtgatgcctctggctttgttctttttgtttagaattgctttagttatttggactcttttttggttacatatgaattttagaatagtatatttctagttttgtgaaaatgacattggttgtttgataggaatagcatcaaatctgtagattgccttgggcagtatggccattttaacaatattgattcttctaatccatgaacatggaatgtttttccatttgtttgtctcatctatgatttctttcagcagtgttttgtagttctccttgcaaatatatttcacctcatttattaaatatattcctaggtgttttatttttgtgtggctacatggattacattcttgatttgactctcagcttgaacattattgatgtctagaaattctactgatttttgtacattgatttgtatcctgaaacattagtgaagtcgtttatcagcttgaggagccttttcgcagagtctttagggttttctaggtataggattataacttccactcagagaggtagtttgacttcttcctttcctatgccatttctttctttctcttacctgattgctctagctataagttctagcactattttgaataggagtggtgagagtggacatccttgtcttgctctagttctcaaggggaatgcttccagtttttgcccattcagtttgatgttagctgtgggtttgtcatagacggctcttattgttttgaggaatgttccttcgatgcctagtttcttgagagtttttagcatgaagggatggtggatttaattgaaaattttttccatgtctattgaggctattatgtggttttgcttttaattctatttatgtgatgaataacatttattaatttctgtatgttgaaccaaatttacatcccaggagcaaagcctacttgatcatgctgaattaacttgttgatgtactgttgaattcggtttgctagtattttctagaggatttttgcacctatgttgttcagggatattggcctgttgtttgtgtttttcattgtctttgccaggttttggtattagggtgatgttggcttcacagaatgaattagggaggagtccctcctcttatttatttatttatttatttttgggaaatagtttcactagaattgttaccatctcttctttgaatttggctgtgaagccatctggtctggggctttttgtggttggtaagttcttttttttttttttttttttttttttctgttgcccaggctggaatgcagtggcacactcttggcttactgtaacctgcacctcccaggtcaagtgattctcctgcctcagcctcctgagtagctggtattacaggcatgcaccaccatgcccagctaatttttgtatttttagtagagatagggttttactatgttggccaggctggtctcaaactcctgacttcaggagatccacccgcctttgcctcccaaagtgctgggattacaggtgtgagccatgatgcccagccacatgtagctttataatagagtgatttatattttgggggtgtatatctagtaatgggattgctgggtcaaatgatctttctggttctaaatctttgaggaattgccacaccatcttccacaatggttgaacgaatttacattcccaccaacagtgtaaaagtgttcctattcctctgcaacctcaccagcatctcttgtttcttgactttttaataattgtcattctgactggcgtggtatggtatctcattttggttttgatttgcatttctctaaagatcagtgatgctgagattttttcatgtttgttggctatatgtacgtcttattttgagaaatgtctgttcatgtcttttgcccacctttcgatgtgtttctttttttatttttcttgtaaatttgcttaagttccttgaagattctagatattagacctttgtcagatggattgattgcaaaaattttctcccattctgtaggttgtctgttcgctctgatgatagtttcttttgtgcagaagctctttaatttaattagatcccatctgtcaatttttgctttccttgcaattgcttttggccaatttcatcataaaacctttggccatgcctgtgtcctgattttcttctagggtttttatagttttgggttttacatttaagtctttaatccatcttgagttaaattttgtataaggtgtaaggaagaggttcagtttcaattttctgcatatggctagctagttcttcctgcaccatttgttaaatagggattcctttccacatggcttatttttgtcaggtttgtcaaagatcagatgctttatatgtgtggttttatttctgagttctctattttgttccattggtctatgtacctgtttgtgtatcaatactatgctcttttggttactatagccttatagtatagttagaagtcaggtagcgtgatgcctctggctttgctctttttgcttaggattgacctggctgtatgagctcttttttggttccatatgaattttaaaatagttttttctaattctggaagaatctcaatggtagtttaatgggaatagcattgaatctataaattgctttgggcagtatggccattttcatgatattgattcttcctatccatgagcatggaatgtttttccatctgcttgtgtcctctctgatatcctttagcagtggtttgtagttctccttgaagaggtccttcacttcccttgttagctgtattcctaggtattttattctctttgtaacaattgtgaatggcagttcattcatgattgcagtctcttcttgtctgttattggtgtaaagaaatgcttgtgatttctgcacattgattttgtatcctgagactttgctgaggttgcttaccagcttaagaagcttttgggctgagatgatgtggttttctagatataggatcatgtcgtctgcaaacaaagacaatttgagttcctctctttctattttaatacacttcattttttttttattgcctgcttgccctggctagaacatccagtactatgttgaataagagcggtgagagagggcatccttgtcttgtgttggttttcaaggggaatgctatcagcttttgccaattcagtatgatagtggctgtgggtttatcatatctggctcttattattttgagatatgttccttcaattcctagtttattgagagtttttaacatgaagtgatgttgaattttatcaaagtccttttctgcgtctattgagaaaatcatgtggtttttgtctttagttctgtttatgtgatgaattacatttattgatttgagtatgttgaaccagccttgcgtcccagggatgaagccgacttgatcgtggaggataagctttttgatgtgcttctggattcagtttgccagtattttattcctcagtatttttgcattgatgttcatcagggatattggcctgaagttttcttttttgttgtatctctgccaggtttttgtatcaggttgatgctggcctcataaaatgagttagggaggagcctctccttttcaactgtttggaagagtttcagaagaaatggtaccagctcctctttgtacctctggtagaattgacctgtaaatccatctggacctgggttttttttggttggtaggctatatattactgcctcaattttggaactttttattggtctattcagggattcaaattcttcctggttcagtcttaggagggtgtatgtgcccaggaatttatccatttcttatagattttcaagtttatttgcacagaggtgtatgtagtattctctgatggttgtttatatttttgtggggtcagtggtggtatcccccttatcatttctgattgtgtttatttgaatcttctctcttttcttctttattagtgtaggtagtggtaaattttattgtatttttgttttttgttttttgtttttttaaatccagtgcctagattcattgatttttttgaagggtttttcgtgtctctagccccttcagttctgctcagagcttggttatttcttgtctcctgctagctctggggtttgtttgttcttggatctctagttcttttcatcgcgatattaggctgttgatttgagatatttctagttttctgatgtaggcacttagtgctataaatttctctcttaacactgctttagctgtgtcccagatattctggtacattttctctttgttctcattggtttcaaagaacttcttgatttctgcctagatttcattatttacccagaagtcattcagaagcaggttgtttaatttccatgtagttgtgttgttttgagtgggtttctcaatcttgagttctaatttgattgtgctgtggtctgagatagtctctgttatgatttccgttcttttgcattttctgaggagtgttttacttccaattatgtgatcaaatttagagtaagtacaatgtggtgtcaataaaaacgtatattctgttgttgttgggtggagagttctgtagataactatcaggtccacttgatccaaagctaagttcaagtccttgaatatcttggttcattttctgtctcaacgatctgtctaatacagacagtgaggtattaaagtctcccactatcattgtatgggaatctaagtctctttgtaggtctttaagaacttgttttatgaatctgggtgcttctgtattgggtgcatatatttttaggatagttagctcttcaagttgaattgtaccttttacaattatataatacccttctttgtcttttttgacctttgttggtttaaggtctattttgttagaaactaggattgcaacccctgcttttttctgctttccatttgcttggtaaattttcctccatgcctttattttgagctattcgtgtctttgcatgtgagatgtgtctttcgaatacagcacactgataggtcttgtctttttatccagcttgccattctgtgtcttttaattggggtaattatcccatttacatttagggttaatattgttatatctgaatttgatcctgtcatcataatgctcgctggttaattttgcagacttgttaatgtagttgcttcatagtgtcattggtctgtgtacttcaatgtgtttttgtagtggctggtttttcctttccatgtttagtgcttccttcaggaagtcagtgcaagtcaggcctggtggtgatgaaattcctcagcatatgcatgtctaaaaggaatttatttatcctttgcctataaagcttgttttgcttgatttgaaattctgggttgaaaattgttttctttaagaatgtggaatattgccccctaatctcttctggcttgtaggatttccactgagaagtctgctgttagtctgatgggcttccctttgtagatgacctggcctttttctctgtctgcccttaacactttttctgtcattttgaccttgataaattgaaaattatgtttcttggagttgttcttcttgtggagtattttattggggttctctggatttcctgaatttgaatgttggcctgtcttgctaggttggggaagttcttctggatgatatcctaaagtgtgttttccaacttggttttattctcctcatctctttcaggtactccaatcagttgtaggtttggactttttacatagtcccattgttcttagagattttgtccatttcttttcattcttttttccctaatcttatctgtctgccttatttcagcaagacaggcttcaagctctaatactacttcttccacttcttgaatttggctattgatacttgtatttgcatcagtatagctgcttcctgttccagtgtggttcctggctgttcattttcaactgaaagcaaatgttgagtgaaagtttttggttttgcagaaacttccatacgagaggcctttctttttcttctcctggtgaatattttttggaaataagagaatgcccccattacaatgtaacctttgctgtagcagaaaggacaaagaatgcaagatccattttactctggaggctgttaaaatatttacagaggatgagagatacctactggccaagatgacaaagacatactccaagtctatggagagcaagcttttctgttctatagcagtatgctgtctccttgcaggtgatttttctccagaggtaaaaggggctctttctcagaaagaactgactctattgttggaaaaagactgtttccatggcttttgtattgtagaaggggaaaacacttccagcttcaggcaggacatgtcttttgggcaaagaatagctatgtggggaaagggtgagaatatgtcccttgcctccatcctgtagagcctccctggaccttctgaaacatccctccctctctgtattgtcctaaactaggaatcagcagagcctgccaatctgggtgtagaattgcaagggaaatgaagaaaaaatctcctgtttgaaggtacattagttctttcttaatagtgagtcgctaattttacaaatttattccttagatcatgtcacttaactttataattaggagaatattctctgttattttgaataacgactcaacttgcattctttctacttttagtagtaagagagagcagagacatttgcaaagggatcagaggatacaattcttgcaaatgtcagccagcagaggtatctatttgggtagaaattgggaagtttaatgtaatctgcaaaataatgtaattcgagaagttaatcaggaagtgtgtgtgtgtgtgtgtgtgtgtgtctgtgtgtgtgaattgctgaagtagtaggaaagggcctcaatttagaaggaatttcacaaatctttgctcagttatacactcaacctttagattgctctttgtaagtgggagaggagagggattggagaactcagttatatttagccacatatttttcactttcctgtctttttttctccccagtttaagagcatagaaaaacattaaaaattttgaatttacctggtcctctctctctctccctgtcttagtgattgctttacacttttcagatattactatctcttctattcttttattgatttttatgctgcggatttctttagtgtggttttactttttattgtttctaatgttatgttcagtcagcagaaattatattatatggctctgcattttcatcttaccctgaaaaatctctgtaatcatatcctgatcatatccagagttaattttttgtgaatcctaaagtaatggagaactgaagcgagggggtggcagagttggcagtgagggctctatcacaggctgccctgcacaggtgcctgggaagcacccctcaagagggacacatggagccttgattctttccctggatccctggaggagtaacaaatatcgtggtgcagcactggagacactgaggctttgtcaggtcagggagtgagagtgtgaatgtggccatgcctgaactctccctgcctgccaagctcaggactgcagacgtcaaggatgtcccactgggcacagaaacactgaatagagggggtcctgcccacagactatacccaatgagctggtaaagaatccaggagcaaatctgtccctgtttaggcactcttatgttttaattctcctaggaggagactgcacaaggctcaggactctcatttgttcaaaaaagcagagcccacgtgcaatatgaagaagttgaaagaaccagccacagcttgagaacatggaaggagaacagagactggaacagcaacaggtcctcaggagatggaacacttccaatgagagcatgaagtcaactgttcagattattctaattagagggagagaagattgaagtggatgctgagagcagagttctcctatggagatgtggccaacatcagcgtcccagggtggatgacactgatgccacaggagcctgtagtttactggaaaggatgaggtatttgactacctgctgcctcttgtggtttcttccttggagccaacaagtcattccactgcagggaaaatttttcatggggccaatgcaatcaaaggaaactgttaaatttaggtcttgatacagcttcccttgaaaacaaaacaaatgaaataatatttgagcagaagatatacaggtaggtatttgaatacatttagcaacaattggagcagagctttcccagcaagacagatactagtaatgtgggtatttggtgatcacaactgctaatagcagcaaagacctttattaaaatttatttaactcaattgaaaatagatcattggtggctcaattcttttttttttcccagtgggtgccttctacacttggttggcacatttaaagtgcctactttccacttcctgaggattaggttccaaagaacatgtttggtaaaataataatgcttttatcattttatcaattagtgctgattttaatgatatgtttatttcaatactacaattttattttatgatttttaataagatgagtttataaattaaataaaaaccaccatattaggtaggtgggctgagtttggcattaacgccaaactcattggtaagctgccctttaaaagcattcactgcctcagtgcaggaaatggaaaatatttttccatcttggtcatacaaaacatctggtggcatgatgcctccagctgttctttttgctcaggatcattttttctattcgaagtcttttatggttccatacaaattttagtatattgtttacaatttctatgaagaatcattggtactttcatagggattgcattgaatctgtagattgctttgggtaatatagacatttaatgatactaattctttcaatccatgagcatgggatatctttccatttgtttgtatttttctcaatttctttcattagtgttttatagttttccttgtagagctctttaatcttgttggttaaatgtactcctaggtattttattgtatttgcagctgttgtcaatgggattgccttctggatttcttttttagctagttcattgcttgtatatagaaatgtgatggattttgtatgttaattttgtatcttgcaatttttctgcattagtttatcagttctaagagttttttggtagagcctctccaaagagcctctctttggtaggtttttctacatataagaacatattgtctgcagacagagacaatttgacttcctcctttccagtttggatgccctgtgcttgagtccctggcctgagaaacaaccccatgggccaccccggcagacatatccccaggatggctgagcagctgtgtgaccatatcccaggcctgaattaatatttgtaaagatcttagaatagtgtatcattcattgcaagcatgcgatcttgtttttttttaaatttttttaatctactttttttaaaaaatatcacaattactactagccaggttaagagcagaatcttctgggataatctaattccctctcttttaactgtaggtttatggaagaaatttttttattgcctttccttgcctgagtagatttattaacttggtagagtgttcaggcaaggtaatatccattaccttgccagagaggattggtgttataacaactggggtctgattgcctgtctcttgggaggcagttggtgtgactcctcccttttctcctcagagctgatgacatgtatgcatacagttagatagaaaaaataagttttaatgttagataccatggtagggtgactatagttaaaaacaatgtatcatatatttaaaaaatagctagaagagaggagttgaaatgttcccaacatgaagaaagaatataaatactaaaagtgataggtatcctaaatactctggcttgatcattacatatcctatgcatgtattaaaatagcacattaccgcataaatatgtacaaatattatgtattagaaaaataaaaaatacatattataataaaatgcaagggaataagtaatgtggactcaatgaaagaaacgtcatgtagctggttttgcaaaactgagggcagttcattgacccaggagttgctcttcttggagcctctagcagaagctgccatttccctgcctttgtatacctcaacattggccttcattcttcttctttgccagagcacctactcctcaatttggttgcattgaattttgctagcttacgctttgcaattttgtcactagaaagtcacttccctctttcactttcatgacatttgtacttacgtttgttttctgtttgctcacaaataatgtcatgttttgctttttaggaaagttcaaatgagaaactaaaaatctgaaatcttgaaaagtacagaggaaaactatgtggcttatttgccttttacttctttttatttgtgttacttcatcatgaattagaatgtaatacagaaagagtaagacaaactttgcccagtaagtaaatcatgtgaacagaaattatacaaaaatttaaaatggaaaaccacaaatgagtaaaggaaagaaggctatttctccctgacataatagcctgggcctaactgccttgcattaccagggtgagacagagtaacaaagaaccctaagagaatcatgctgagtggatgaacaactgaaagtcactagtttctgtcatattagtttctatgagagacaaaatcatcattgaatcccctgtgcctagctctgaaaggtcaaatataacaagtattcaatagttttaagtattggataataaaaataagactggagcaataaaagctatacttggcaaaatacaaattgtttgcttacttgagtaaaaattattgcaattgaataattcttccacctacttagacaaaacaaattttgctatcagtatctgagcactgtggacacatttgatacctggggatatggggtcaggacaggaggaggtaaccactgagaagcagagtccttcacacaaacactctaggggaaagggcaagggtcttagaggactaattattttggctcaaggaaatagtcccctccttagtgaaagagttcaaaagttgtcagcctgcctcagggaatgagctggggagagcttgagttgaggacattgtcactctagaggaaagggtgttactggatgtgataaaaactttgtgagtgaagtgatggtgggaaaatacaattatcttagaatttgaatcgccgtatccccatgcacctggaaaagaccaggattcttgctagggatattgttgggaacaagcccccccaaatctggccataaactggccccaaaactggccataaacaaaatctctgcagcactgtgacatgttcatgatggccataacgcccatgctggaaggttgtgggtttaccagaatgagggcaaggaacacctggcgcacccagggcagaaaactgcttaaagggattcttaagccacaaacaataacatgagtgatctgtgccttaaggacatgctcctgctgcagttaactagcccaaccttttcctttaattcggcctatcccttcatttcccataagggatacttttagttaatttaatatctatagaaacaatgctaatgactggcttgctgtaaaaatatgtggataaatctctgttccaggctctcagctctgaaggctgtgagacccctgatttcccacttcacacctctgtatttctgtgtgtgtgtctttaattcctctagcgcccctgggttagggtcgccctgaccgggctggtcttggcaggatattatcacagactgaggagcactcagtaagaacattatgggaagaaagggctatgtctatagtaatcctgacctggtggccccagtgaggcgtaatcatatggacccgcatgaatgtattttagaagaaagagaaacatgatcacagcttctactgtgaataaaagagttaacaaaacccaattatttgttctaaagagcttattgtcgcagatggtctggtaaattgccaaccaaatacagaaacctatccggtagagggcgcctgatttcctatgtaaagcatggagagtaaaatgtagcttagaatcagggcaaaaattttgctcctgacatagaagagaatatttatatatgaaaaaaatgtatgtgggcatttttgtgtatgagtattcacatttctacatacacttcagttttttaggaaaaaagatatttctaatttaattaatgaaaatctgatatctgatcaaatcctcatcccacgcactcaatatataattaccctggcttgcctttagaaagaattatgttcaggttagcaaggatccccctacctttgatgtctccttttagtgattttctatccactgaccccctcattctgcttgttgggtataaaccccaggctgtctttgctgatttatgagctgagcaccaatgggtctctctcccgtattgatatggtttgggtcagcatccccgccaaaatctcacatggaattgtaatctccagtgttggaggcggggcctggtgggaggtgattggatcatagggcggttcctcacggtttaacaccatccccctggtggtgtcatggcaagagtgagttattccaagatctggttgtttaaaattgtgcagcacctcccctgcttctctcctcctgctccggtcatgaaggacatgcctgcttccccttagccttctgtcatgattgtaagtgtcctgaggcctccccagccatgcttcctgtagagtctgcagaatcgtgagccaattaaacctcttttctttctaaattacccagcctcaggtttttctgtatagtaatgcaagaactaatgcacctatcatgatagttttgacacctgttgcaatacttttaaataaagccttccttactgttataccaagtgtcagaataaatttttctttaccagatccttaaattaaggcagtacaatcaacactgcagcatactctggtgacctacaacataaaaggcatgaaccagctggcaagtcaggtgactcagggtcttttgtcatctcagtcctcatcctctaatgccatggactctcctcatttctccagaagtgtttccatttccacacctttaataattcctttactttagttaacctttccaggtgtgctctccctgagctctgagccttagttcattggtttagctctgatttagttcatgtctgtagcctgacaatgacttgttctttcttaaatttgtgctacacaggtggaaatctaaagtatggtgcatatttgattaaaagaatagtactatgtagaattttaaatggatagaaatatatagggtttatgaatacatttactggggcaaacaacatgttttacaaatacactcatgtttatgatagtgtatcctcaagaagacaaaactagaatataacgtatatactcctttacaaggagcataagtaaagcggggcccaatttcattgtaatgttgccatgagcaaatggggcattacagtgaaggagacaaatggaaactgaagagaaagactctgtcattacataggcaggactctactaggaaaggattgactggtctataaatcagctctggttcttatggcccgaaatattcccagagagcatgtaagagctaagacttcagagttgaattttctgcatccaaactgtagctccaaaacttaatagcttcctgtgctttcattgtttcttttgtaaatggggacaatagtaaaatctgtcactgtgtgccttggtcagtgatatctccagtgaataaatggggttagggacatggtagatgttcagtaaatacgaaaaacaaaagtattctttattggctaagtgagcatcgattatgcaagtgctaaaaacagtgtctgactgaaaataaagactgtctagagtttagatatctcattcctcttattaacattatctttattatataactctattaagttggggaagtgtcctttgaaattatcaagtctcttgtttcttattagaaatataacaagaaaaaaattgatctttggagtgtacttatccactagtggagagcttggtgcaatgaacacttaactattttccagagagaatattgcactctctaaagtttgcctttcttgtgtataaatgcttgcagttggtgtgtttgcaagatgggcttcagtaaatctgaaaacaccctgtggaccaggagtaattacttttcttccagcccatacttatttgctacctttgacctatatcccttctaccattttgcttctgttctttcccaccccttaacctccatcatggctgggctgaatgcagctaaggtacattttgtcattgttttttcttagtgggatattacttccatttacattttaatcacatttagatatatttttgttttatttttgtccccattcattagggtgcaaaaagtgacaatttttgctttttatgaaaagagaaagaaagatatcatgtctggcatgctatggaaaacaactgtacaagtcatttatgttataacatttacatctcattatgaacatttaggacaaagatggtttcctttagttggatcagaatcaacaaagaacctctgaagtttctttggaaatttgaattttcatgcaaaaaagtgtttttaatcaaattgaggatattttttcaattgtgtattctcattgagtatgatgctactcccaagggtgtaaaagtgtagttcttgagagtgggaacaaatcttacagatttaaatgatttgtggcccttcaaagttcaaccctatctaacaaagtcttattccttagttttttgttttctccccattgggttttcttgtgtatcacatgagaagcattgacattaagttcatggaagatacacaaaatgtatataagttcagtgttacaaacctatggaaaatgagtggctgtgattgcagtactttccaaggcttactagatctcacagtcatatcaagagatgtgtcctctgcatacatatgttttgtcactggccatcttatagttgttgcttatttttgatccttagcatttctaactgtgttgtgggctttgaggataatttatattttattaattctacaaaaattgttcagcacatcaataattaggtcaagcatcgaagaaaaaagtcttgacaatatttaggtgactagcagctagtgaagttaaaaaatttcacacatgcaacaaaattaaaagttaagtacaaccctgccacagaggccgggagaggcgactggccctttgttggtctgtgagaaatcaaacttccaacatgacaagcaggaagcctgcggttaagggagtcagcgtgtcacaaatacaagcacctggggtcttccaagagcatcatacctcctccagcccctggagccacctgctttcctaactggctgtgggaaatggcctgaggtcccagatgctgccactgtgctgctgccttccactctctccaagcagagcgcaagttcagccacctttgaaagacacccaccccctggcctggggatgcacaagttcagagctttgcagggagtaaccatgggttatggcttcatgaaaatgtcctactcaccagtgcctttttcgcagatgtggatgtggaggcatgagggagggtaattattggattaccaaggtgctgctaagagcagaggaggaaacccctattcccagtcatatgtctggtgtgacatttcactaacccatttaagtgcacaggcctccaaatatctacctaatgagtatgatggtttgggcattttacacttaaaatcactggcctcatgtcaactgaagcctgactggccagtgtctcaaagtcacagatgatgacctgatccctcaggaacagatggtgtttcagctttgtgggagtgactgtcaaggtatggagcacttaggtggtctttgaaacctgtcaggtttcacatctctgctttgagtgaaaagctcatcacccacagtagtgaggaatgtgcctatacttgctggggctgatctgttgaaactttatgtgtagacaatggaaacatccaggagcatttctgctttcatgtagcctcttaataattgatgtccctgaagtcctgtgtcctcagggacagttcctctgattcctggattgtaccagctttcatgatgttaaatctaatctgtaaaactctgagcattaatctccatgaaaataagaccttgttctttctcatttaaatgccccttttttttcttgtctaatattctgagtaggatttccagtactgtgttgaaagaagtagtgagagtgggcatccttatcttataataaatctcagaaaaaagattccaacatttcaccactgactatagtgttagctaatggcttatcttatagctaataaggaatgtgtctctttattctgaggtatattctttatatacctaatttgttataaattgtattagagatggattttaaattttgtcaaaataattttaggcatgcataaaaatagttatgatttttaatcttttattgtgtaaataaggagtatggcatttattgattccaacatattaaaatattcttgcatcccaggaataaatcaagcttgatcataataaatgatccttttatagtgcttttgaatttcatttgcaactactttgtggatgattttgcatctgtgttcatcaggaatattggctgtaatttttttttttcttgtaatgtccatctctggcttaggtatcaaggtaatgctggcttcataaaatgagtttgggagtattcctccttaattttttcaaagatttggttctgtttaaatgtttggtgaaattcaggagtaatcagatctaaaaaaacgtaagaacactaaaaataaatgataaaaatattttaaagttttaagtgtttatcactttcaaataatttttaagtattcattacttagaaaatgtttatctataaacattagaaaatgtttataatttgttaatttgcttatgtaatttgatacactacaatttatttgtttgtttgttttttgaaacagagtctcactctgacacccaggctggagtgcagtggcacaatctcggctcactgcaacctccacctcatgagttcaaggaattccctgcctcggcctcctgagtagctgggattacaggtgcacacaaccatgcctagctaattttttttttgttttttttttgtttttttcgttgagatggggtttcaccgtcttggccaggctggtcttgaactcctgacctcgtgatccacccacctcggactcccaaagtgctgggattacaggcgtgagccacctcgccaggcctacagtacaatttatatcagtaaataaattacgttgaagtccataagcaaatttagttataaagttaagaaaaatttgaatagattttaaatttaacttttagcttaaatttttcatttggttatttttaaacctgcattgaatacaaagattaaactttgtactttttgattatagagatatacatatagtatataaatagatacatattgtatctgtgttattaaattttcacggtgggttcaattaggaaaaagatatctaaaaagtctctgggaacaagatggggaagacaataatgaaaaacaaaacatttgagaaacacggctctaaactcatgtaaagagtgcatgaaggaaagcaaaaacagaaatggaaagtggcccagaagcattaagaaagtggaaatcagtatgttccctatttaaggcatttgcaggaagcaaggccttcagagaacctagagcccaaggttcagagtcacccatctcagcaagcccagaagtatctgcaatatctacgatggcctcgccctttgctttactgatggtcctggtggtgctcagctgcaagtcaagctgctctctgggctgtgatctccctgagacccacagcctggataacaggaggaccttgatgctcctggcacaaatgagcagaatctctccttcctcctgtctgatggacagacatgactttggatttccccaggaggagtttgatggcaaccagttccagaaggctccagccatctctgtcctccatgagctgatccagcagatcttcaacctctttaccacaaaagattcatctgctgcttgggatgaggacctcctagacaaattctgcaccgaactctaccagcagctgaatgacttggaagcctgtgtgatgcaggaggagagggtgggagaaactcccctgatgaatgcggactccatcttggctgtgaagaaatacttccgaagaatcactctctatctgacagagaagaaatacagcccttgtgcctgggaggttgtcagagcagaaatcatgagatccctctctttatcaacaaacttgcaagaaagattaaggaggaaggaataacatctggtccaacatgaaaacaattcttattgactcatacaccaggtcacgctttcatgaattctgtcatttcaaagactctcacccctgctataactatgaccatgctgataaactgatttatctatttaaatatttatttaactattcataagatttaaattatttttgttcatataacgtcatgtgcacctttacactgtggttagtgtaataaaacatgttccttatatttactcaatccattattttgtgttgttcattaaacttttactataggaacttcctgtatgtgttcattctttaatatgaaattcctagcctgactgtgcaacctgattagagaataaagggtatattttatttgcttatcattattatatgtaagatgtaagtaaaaatgacctttctctaaaccaggttgtatgttgtactcaagatataaagctgaatacaataaatctacttcctactctcttgcatatttggtttttgtatggaataaaactaaagatggtaatcatacttaatatcagttatcctaaatactatgagaagaaggagcaactaatgatttctctcagcagcgggtaaactgagacaggtgaggaaataaaaataaacagatatcctcaaaagttgactggtaaacatctagtagaaaatgtctattgccagttggatatatgagtttgcaacttacaaggaatgcagttgctgggggttcatacatggcaagcaaaatcccagaaatggaagtgctcatgtgtggagagagtgtagacagagaaaaggacttaagcaggattttgaggaccttccacctttaaagtgagggaagagaagagacacagaggaaccagaggtggtgtcccttatattagactaacaacaagagagattggtgattaatatggtttggatctgtgtccctgcccaaatctcatgtggaattgcaatccccagtgttggaggtagggcctggtgcggggtgactgggtcatggctatttctcatggtttaacaccatcccctttggtgctgtcatggtgatagtgagccctcctgagatctagttgtttaaaagtgtgtggcacctacccctacccttcctcttgctctcgctttaccttcctctctgaagcctccccagaagcagatgctgccatgcttcctgtatagcctgcagaattgtgaggcaattaaacctcttttcttataatttacccagtctcagctatttctttgtagcactgcaacaatggactgatactgtgataaaagtgtatttaagaagataaatgtgcggggaagatgaatcagtagattttcccaagatacggattaaaactgcccagtaattgggaaatagatagccttggcaatcttagtgagagagctggtttggtggaattaataagtagaagtcatactgcagtaggatccaagtaagagaagttagtgactctgaagtgaagatggaaatagaatggaatttgaaaagaatgtggattattgtttttgtacacagtttttttttcttttttgcagtatattttttccggatagatttcatgtaactgatgtactggcaaccatattgatatgtttagtatatttatgttaaattaaaatatttaattacaatgataatttttcattttttaaataaatactactttgaatatcagtaagctgccttaattctgtaggtgggaatagaaaactaattcaatccgtcatcacaatatttaattaatactgataatataatgattcctggacctactggctttattaattaagttacttaacttgcgtaattgtaacactggtttactataattttacttcagcttttaacacattttattttctggtagagctcatatattacttcttggcaatttttcctgatgttatgaatattacaatcttatgccaatccaaaaataactaaattaccatcaacataaagactgaaaacttccttcacaaattaataatgaaaagggaatcaacgaatctctgtctcaatacttaagataaagaaaaagttggtcataaccagctgaaaatacagtatgaaccatggaaattcagagagcaagaaagagttgtgtagaattcacaaggaaaaaaaaagatttaacaattataactgggccgggtgcagtggctcatgcctgtaatcccagaactttgggaggccgaggcaggaggatcacgaggtcaggagatcgagaccatcctggctaacacagtgaaaccccgtctctactaaaaaatacaaaaaattagccaggcgtggtggcaggcacctgtagtcccagctactggggaggctgagacaagagaatggcatgaatccaggaggcggagcttgcagtgagccaagatcatgctactgcactccagcctgggcgacagagcaagcaagccgtctcaaaaaaaaaaaaaaaaaaaaaaaaaaaaaaaaaaaaaaaacaaaaacaattataactgaaactcagaatacaaaactgacaaaatcacccataatttacattatattacaaagaatttgacattgaaatttcattctgcttacatgtatgtgtggtgttaagaaactcaatctctttgagcctgagttttctcataaataaaatggattcagaaaatttatatagttgtgatcataaaggaacacatgcagtttaaagcacctaccacagtatcttccaccatgttgcctggtcaacatgatgaaaccctgtctctactaaaaatacaaagattagctgggcatggtggtgggcgcctgtaatcccagctactcaggaggcttaaggctggaaaattgcttgtacccaggaggtggagattgcagtaagctgagatcacacctcactcaaggagttaaacgatgttaagtattttcctccttttcttcatacagctgtagatgggaatagtatttgtctttctgtaaaatttttaggatctgtggtgtcatacctttcaggaattgaccttcaaaggaagcagcctaaaaaaaaaaacccacagattctgtcatgaactgtagagaggctgaaaaattgtcattcctcacttcagagtgtcctatttatattcagtcaggaaatggtggcttgtataaatacctgagacaagagaataatcatgcagattgatgcgcagaagacatgtgatgtttcttgactgattatggcacctggcacattctctctctggctttactcccttcaccttcctgcccattcacacagagctgttttctgttctgttgtggtttcagcttgatggcttccctaaagatcagaatgccacaagtgctaagcagaagtgaaataaaatttctaggttttgcagaactacctgcaagagaggatttcctgaatttccgctgagtatgatgtaatagtaacttaatgaaaaggaaagagaaagcagaatgtagtttatgtgcagtctcctgaaaacctctcagggaatcacaacctggtaaccaaaggtgacaagggcagccaccaagactggagggctgatttctgatctatgcagaaacccatcacttctgggcatttctctttatgctgcaaaaattatacttcttggcaagaaaagatgctaatgctgtcataagcctgttccttacccttggtctaatacaaagagaatcagtttctggctaccatcagggcatgcattttttggaactgacagttataaggatatagagagagatgtattccttgcctatagaccactgtgcataccagcctctaggatcaccctctccacataccacgtatgggactccagggaacaggcagaccgaccaatcttgactggaacttaatagtatccagaacaagttcgtgtttaatagtgcattaaacagctattaatagtacaattttagtttcacagatcattcctattattagacttcaaacattaacaaataaaataatattctcattgtcactttgaattatgatcttgacagttcttccacttaatagtaaaaactctgccttggtatcaaaagagagaagtctcataagagctaatgagtgtgaaagaatagtattgttaccagagagctagtgaggtttattcattcaaagtgtatcaattctggtatgatttgaggtgtatttttgtaatcagcaatatattttcattgagatgttccaacaggatgtctgtgtgaattcttgagttagcagcaaggaagagcctgaaattgcagaggagtctcttcatgtatccctcaggccacacattgtgatatatatatatatatgtacatatatacacacatatgtatatcacacattatgatatatatatgtacatatatacacacatatgtatatttacagttattttcttattttataaatatatgattattatttcctttatatatatacattaaaaaagggactgggtgccgtggctcatgcttgtaatcccagcactttggaagccgaggtgggtggatcacttgagttcaggaattcaacaccagcctggccaacattgtaaaccccatccctactaaaaatacaaaaattagccaggcgtggtgatgggtgcctgtaatcccagctatttgggaggctgacacaggagaatctcttgaaccctggagccagaggttgcagtgaactgagatggcgccactgcactccagcctgggtgacagagcgagactccatcaaaaaaaaaaaaaaaaaagaaagaaagaacagaaaagagaatactctcctaaatctctgtaacacatataatataaaaagcagaattcttggagtattctggagaaaactgaaaaataagtcacccttcatactgaagataagtctcatttgtatattcagtcaggaaacagtatcttacagaaaaatctggaagagtttattttcttaaacctaagtgaaatagacatagacatactattcatttgctgattccaatacccagcacagttctctccttcttccccagcttttctggatctcattcttcactcctattgaagctcggaaaataatacgccaaagtgaagatctaagaagcagcctcagaagcaaagtttctctctggccttctcctgccctcctgtttgtcacccctcatctcccgaggctagccataaaaagtagaaactctctttcccaaggctggtaatagaaaccagagccctttctctccaaagccagccataaaaacctataaacattacttgaactttcccttacctttgtgtgtaagaactgaactggccataaagaaattctctgacctgccttgtttgattgtagatactaagacccccattccaaaaagagctctgccacatacccaagaggaaggaatggtgcatggagaggccaagaagtatctgaccagaaaggccttgctgggtttcccctactcagaatattagcattagatgatgccctttttgtctaatcacatttctgcacagctgcccattcctcatggaatgtaagcataaaaatggatagttttttcctgtactttgggtcttcattttgaaggcttccatagttatataaaacgatgattaaataaacgtgctatgcttctcgcttgttaacctgccttattatagccgtgtcagctgtgacccttttgataggaaggaaagagatcacactatttctgcccttatagttctgatgatgaagatgggatgtctgaagcacctgactcacctattgatgaggtcctgggacaactgataaagagctggcaaataaaggtaagaatttttaccaaggtgagttctgaatctctgcctgtagtttctggtcaagaactaaaggtaaaaatttatctttatatcttactttccaaatgcaggtcagcaggagatcatttgtttgaactgttctcttatgtaaatttggatttcagggactcatttgttattgatcctttcccttcaacgaacagctgtcattttcctgttttgtgtcctgagaacccaacttggcttgctgcctgtcaggacacactttggtgtgtgaagggggctaaacaaatgttggaggctcccattaaaagcttacatattgcctattgccagctctcaaggcatctaaatctttctttcttttggctatttgtgggggtagctctgaattttgagagggctgcatctttacatttctttaatgatgtctcatgtatccttggttaagtcacaaaagacttggttttggttctgagtcgcttggtaggtatcgttgttttaaaagaagagaaaaaaaagaaagtttcaaacattagaaatattggttgttttttcttgctgaaatctgataagggatttaaaagtatttttttaaaagagctctgtggtcaaataatagcttaatttaaagctgatatccaggctaccatttttttaagagtctttctgattttctccttaggttcttgtttatcccatgggaatttttttcagtaaacttaaactttttttattataaacttgattcctctgtttgcttcctttcttgtaggcaggatttttaccggttaaaaaaaaaaaaaaaaaaaagagtaaaacttcattggcctttttgggaagcttaagacctacccagtctggctcctctaagactttttcttccatttacttctgtccctccttccttctgccaccttcaatcttccatctaggtctctcttatcatcgacaagcccctgcctctgcatttagtggtcagtggttggaaaattactaagcagaaacatcagagttctggctaccacataaagggatgtagagaagacttctagaaagcctgggattccttgaagaatgaaaaaaaaaaaaggtgccacagacccccccactacatggagtcctctgtcttcctcaggaaccccaagagtcatgggtgggtccttcttgcatctggagctctgctctcccttgccttgagttccctgatctctttggcttttggggtatcaagggtaacttcacactgtgagagagccacctacctgccaagaccagagacagtgggcaagtctgttctctgtataagtctgtcgccttccaccagctttttcttcagagctaaaaggaggaaatttcctggaaagaactgacccaaacactggaatgagcccatttctttaaatttcatgtcttagagaggggatatactcccagcttcaggcaggacatgtcctctttggacaatgggcagctctggggagagaaaggggcaggaggtgtcccttgcctccagcctatgcagcctcccaggacctcctgactcgtccctcactctacttactgcaggtcacgtggaagtgagagccaccccatctgactgtggcacttcaagggaaatcaggaaaactgtcctgattgaaggtacattaactctttagcgtaagttgtcagttttactaatttactcctcctatcagatcatgcccctcgactttataattgagaaaattcttactttccctttgaataaggaatgagcttgcatcagttccatctggattcaatagttttagagagcactaacataaagtaacttcagagaatatagtgactgccacaggtgtcaacagggtagaattgagaggcatcttggcaatattgcaattaaagaagtaatcatggtcagttgctcaggcagccaggcaggcattcaatttagcagggatctctcaactctgactcaggttagaaacccaaccattagattgtttctcttctattcgtgggttagagggccctaatttacatgttaaaccatttttcctttcctcctccaccaattgtagggaaccagtttagcgtcaggacaacatcaacattttttaattcacttggttctgtcttttgtgattgcctaattagcctttcaaatattagaaccccttccattcttgggtaactgcttacattttaatgtaattttttccttacatttatattatactttttaccatatttatatgtaaaagttctgatttggcttcatattgtcaccctcccctgaaaaatctctatagccatatctcatttcatatctcacagttttcaacttgttatatataatctacagtattggggaacccagtagcaggtttggaggcacctaggcagggggagtggtgggggcactgagtgctgggccgctggccctgccctcgtcccactgaggagacaggttttactgctcccaggcccacctccacccaggaacatctagtccacctgagaaaaggtgtggggaggcagggatcagtgcctggtgcccagagagacatggcgaggtatcaccatgcagcaccctctggagatagtcctgtttttcaagcctcagaagcaggagtgtgcgtgtggccttacttccacccttcctgccgggtgagtcatgagctgtaggggtgtagacccactgatgtccagtctggcatcaaaatgcagtaaatgaagggagtcctgcctatacctctatgtccattgagctgataaagaatgcaggagctcatctgtgactctgtttagaagcttccacgttctgactccttcaggaagagactgcaccaggcacaggactctcatttgttcaaacaatgaaagcacacatcatgcactggaataagctggaaaagccagcagcagcctgagaacgtggaaggaggacagagatgtttaaagcatagacatcagtgtcaggtactcagcagatggaataataccaacgagcaccattaagtcaactgttcagatcattcttatcagaaggagagaagatgaagtggattctgagaacacagagttctgttgagctgtggccaacatcagtgtccatggcatcggtaacactgacaccacagcagcctgcagaatattgggaaggatgggggttagtccgttcccagatgcaaacttttgatttctccctagaacccagcaagtcatcacagtgcagggaaaattattcatggggacaatgcagtacaagggatctcttaaattctgctcacgatgcagcctcctttaaagaccaacaatacgaagacaattcttgaacagaagggtcacaggaagacctcccaataatgacatttcattctatgtcatttccttgtaacactgatgagagaagaaactgagtgcccaccagggccttgtctgtgtggagttctccccatgcctgcatgagttttctccaggtacttcagtttcctcctgcatcccaaatatgtgcatgttaagttaattggtttgtctaaatttctccagtctcagtgagtgagtgtgtgtgtgtgtttgaatgtgccctgtgattaaatagcttcctgtgcagtggggttttccaccttacaccctgatctgtgaggataggttcctgccacccttgaccctgaaacggaataagtggattggaaaatgaataaatgaatgaaggagtacaaatgattgcaaaacaaaaattcataaagcatatgacacttatatagatgcacaacaatgcatgaaagtgctcagtgcgcccaccatatttgtttctgtttgttttggaactgcttggttgtaagaggtgttccttacaattttcactttgtaaacatttattttttgataaaaccttctattactatgactggaaaatatcatctattgtaatgccaaccatagacagccaaagacaaccatactaagcaatgtggctgaatctgtagttaaagccagatcttccttggcaagcagccctttaaaagcattcattttgtgttgcaattgtagcagtgagacagcaaaatacctaacataactaactccattttgtttacggggcctacacccattcttgcacgtaggttgggatgattttagagcagagataatgtgcaaaaacagcaatcatgtaatttttaaaactaactctgggattaaaggagaagaatgtaaacaactaactaggttaccttaaagattcataggagcattgtgacctgacaaagaacaaagaatttttcaaattccttggtcctgtgctggtgcccagttgtctgctattgatggtcacctatttatcctgacccccctcctcttctgcctgcccttaacataaaaagagcctgaaatttgtactgccttaagatggtatttgaagatactagtctaccgtcttctcagtttgcaggctttcctaatgaatctgcttccccctcaacatctctcttctcttgagtttggttttcgagagatgagcagctgaacctgggttccttttcactaacaaggagtacctgaggctgagtaatttataaagaaaaaaatgtttatttggctcacaatgctgctggctggaagactgggcatctggtgaaagcctcaggctgcttagatgctatacagtttagatgtttggtggagacaactgagatttctatagtttacatgtttgctggggataaacatctaagcatcacaatcttggtcatatgaatgatcttttcagcactcacaactcaaccaatggaccgaaagagaaagaggggaagagattcttcactggacacaatcagtacacaagattaagtcctgaatgggctggggatagaaatatccttctccttggcaataagagcagcaggctgacctgtgagtcctgaaggaggagaaagtcagagtccatatggctgggctgtcccagaaattattagttgttttctctttattcttaaatacacaagaaaactcaagagtaaaaaataaattggcttctaggagtttgcagttgataggttaatagagttgttttagtatatttttgaagaaatcactaattaaatgttatgatttatttttttaattggcagacaaatctacttcattttactacttaaaagatatttcattggctgggtgcagaggctcacacctgtaatcctggcactttgggaggctgaggcaggcggatcatttagggccaggggttcaagaccagcctggccaacatggtgaagccctgtctttactagaaatacaaaagttagccgggcatagtggtgtgcactgatagtcccagctactccagaggctaaggcacgagaatcacttgaacccaggaggtggaggttgcagttagctgaaattgcgccactgcactccagtttgggtgacaaagcaagactctctctcaaaaaaaaaaaaaaaaaaaaaaaaaaggaatgtatttcatctacttttccactgaacttaaggcagtcagttcaattcatttacactacaccccctgttgctctgtaaagcaatagacagcaaccatttgacattcaaaatgcatctcagaatcctagtcatctcactctccctgctccattgatttgatgtcctcttctttactttctatgttcatatctatcccccacttcctttaaaggacccttccagaaaagccattatattgattctccctaaagttttcaccttgcacaattggtgtggtcagaatagttcatccctccagatttatatttctctccaaacagttgtataaaagggtgtaatccaaatagtgttactgagaagacagagttagtattttaaaaatatcttaaaacagcctggcatggtggctgatgcctgtaatcccagcactttggaacactgaggcaggatgatcgcttgagcccaggagcaccagaccaggctgggcacatgttgaaaccctgtctctacaaaaaatttgaaaaattagccaagcatggtcgtgcatgcttgtggtcccagttactcaagagactgaggtaaaaggactgcttgagcccagaaggtcagattgcagtgaaccgtgatcgcaccactgtactgcagcctaggtgacacagtaagaccctgtctcaaaaaagaaaatcttaaaacagtggatggttcctattaggcatgcaataaatgttggtgttatcatttttaatattagtattattattatcatcatccagattaaaatagaaacttttgggatcatccaattctatttctattaattccaggttcctcaagcctatcttatcattgcctgggtggatttattaactaggtagagtcttcagacaagcttaatgtctaacaccctgccagagagcattgttggtgttctagcaactgcagcctggttgtcaatcttttgggagttggttggtgtgacttctgccttctctccagagctgatcacatgtggattaagtgaaagaaagtcaagtagctgatcttcgaaaactctctagtccccaatttttgctgcattgaagtttgctaacttacactttgcagttagtaaggggaaagtcactccccttatttcaatttcatgacaatcagaattgcttctgttttctttctccctacaaacaactgtcaagtagtactttctacaaaagtttaaatgagaaacaagaaaaacacgaattttggaaattatagagaaaagcagtgtagctcttttgcctttcttttactttcctttgtttgtgttacttcatcatgaattagaatataatgtggtagcagcaagacaaactgcccagtaaaccactatgttaaaaaggtgttctaaaaattcatttgttgttgagctttaaatttaaaatgaagaatcacaaatcagtaaaggaaagatggctatgactatttaatgtgatagcatggggctcactgccctgcaccgtcaaagtttcatgtagacagagatgtaagaaacttcaacagatcacactgaactagtgaacaactgagggtcgccagtttctgtaatatgagcctctaaagagaggcagcagcatctttgactctcctgtgcatagctcataaattttaagcataaaaactgttaatagtttaaaagaattaaagatagcaaaagagttaaagaaagaataaaagctgtacttggtgaaataaaaattatttaactactgaagataaaatgattacaattggataattcctttacctacttagacaaaacaaacctttgttatcagcgttctagggctgttgagactttgatacctagggcatgggtcagaagaagaggaggtcaccactgacagcatatactccttcacccaaatattctaggagcaaggacaaaggtcacaaaggatttattgttttggcaacaaagaagcaagaacctccctggaaaaggagttctaaagtcatcaggatgtggtgagcctgcatttagggagtgacttgatgtgataaataccttgtgaatcatcactgctgaggaaataacattattttaagattaaaatttccacacccatatgcatcttaaaaaagaaaaaaaaacaaaccaacagaatttcttttaggggtattggcgcagcctgaggagtgctatatttctccagtaagaaaataatgcaaaaaaggcaatgttcattgatctaagcttgagcccccagggaagcataaccacatgaacctgaatgaatatattctagaaggagggaagcaccagagaagttctttcactaataaccatcaacgtcttctgtgaatcaaatatcaaacaaagatagtcctaaaaagtttaatttccagagataggtaatttcctaactgaatacagaaacccatagggcccagggatcctgatttcctatgcaaaatggagggtaaaactggaggctaggatctgggctaaaagtatatacttctaacagtagcacaaagatgtttctcatctgattgatcaatattcatttggattgatatatcttaagtttactgggaatattgaacatccattgcaaaaatcaagagtgtagagtgatgacctccttttaggtcatatagaacaaggtttttcaacccccatccatggaccggggtactggtcctggcctggtaggaacagggccgcacagcaggaggcaagcaggccaaccaacaagcattaacgcctgagctctgcctcctgtcagatcagcagtggcattggattctcaaaagagcaggaaccctattgtgaagtgcagatgcgaaggatctaggttgtggtctcctaatgagaatctaatgcctctgaaagcattccctccctgaccccatttttcgtggaaaaattatcttccaccaaactggtggccaaaaggttgtggatgctgatatagaagacatgtaaatgaaaacaataaatggaattaaaaatttagagaaatgctcagaaaaatgaaaactatttgtgctccattaaagccatgcatagatagaatgtcttcatagaacctaggatccaaggttctatgaagacctcagctcaaccaggccaaaagcatcctgatttctcaatggccctcctcttccctctactggcagccctagaggtgtgcagctgtggctcttctggatctctaggatataacctgcctcagaaccatggcctgctaggcaggaacaccttggtgcttttgggccaaatgaggagaatctctcccttcttgtgtctaaaggacagaagtgacttcagattcccccaggagaaggtggaagtcagccagttgcagaaggcccaggctatgtctttcctctatgatgtgttacagcaggtcttcaacttctcacacaaagcgctcctctgctgcatggaacatgaccttcctggaccaactccacactttacgtcatcagcagctggaacacctggagacctgcttggtgcaggagatgggagaaggagaagctgggggcagtgggtgattgagggctctacactggccttgaggaggtatttccaggaatccatctctacctgaaagagaagaaataaagattgtgcctgggaagttgtcagagtggaaatcatgagatccttttcatccacaagtttgcaagaaagattgagaagtaaggatgaagacctgggctcatcatgaaatgattctcattgactaatctgccatatcacacttgtacatgtgactttggatattcaaaaagctcatttctgtttcatcagaaattattgaattagttttagcaaatactttattaatagcataaagcaagtttatgtcaaaaacattcagctcctggggcatccgtaactcagagataactgccctgatgctgtttatttatcttccttcttttttttcatgccttgtatttatgatatttatatattttatattttcatcttcacatcgtattaaaatttataaaacattcactttttcatattaagtttgcattttgttttattaaattcatatcaaagaaaactctgtaaatgtttctattctaaaaacaatgtctactttctctttttgtaaaccaaattgaaaatatggtaaaatgtattaactcattcatttcattcctattatatgtataaattgagtaaatggcaaactgtggggttttcttaaagaaatacaggtgaataaagcaaacacagtttctctcagtctaagagggaaagagacgtaaaaacaggacaaatatttatattatttcaattatgttaaatgctacaaagagaagtaaagaaaagtgatgttctcacatcagaagctttaggtataaatggtgcttggaaggaaaaaatattagatatccttcctaaggtgcatgggagatatgtaagtacacgtcttattggcaggtgggaattatgtgtctagaatgccatgggggaaggtgttaatttggggttctttattttatgtctgattatcggggtacgggaatggatgtagtcacataaatagaggggagaatgtgatgaggacataaactttatcctgcagaccctcagcagttaaaggaagggctgaagagtagagtctgcaaaacgccctgaggctgatagccagtgcagttagaagacaaaatagggaagaatcagggaaagactaatcaggaaaggatggtggtactttcagggaaggaagaccaaactatcctagtgaatctgaaaacagaagtcactggtgaccttgaccaatgatggaatatatggtttagtagaattaatggaacagaattaatggaacattccttctgaaactattccaatcaatagaaaaagagggaatcccccctaactcattttatgaggccagcatcatcctgatactaaagcctggcagagacgcaacaagaagagaattttagaccaatatccctgatgaacatcgatgcaaaaatcctcaataaaatactggcaaactgaatccagcagcacatcaaaaagcttatccaccaagatcaagttggcttcacccctgggatgcaaggctggttcaacatatgcaaatcaataaacgtaatccatcacataaacagaaccaaagacaaaaccacatgattatctcaataaatgcagaaaaggccttcgacaaaattcaacaggctttcatgtgaaaaactctcaataaactagctattgatggaacgtatctcaaaataataagagctatttatgacaaacccacagccaatatcttactgaatgggcaaaaactggaagcattccctgtgaaaactggcacaagacagggatgccctctctcaccactcctatcaacacagtattggaagttctggccagggaaatcaggcaaaagaaagaaataaagggtattcaataaggaaaagaggaagtcgaattgtccctgtttgcagatgacatgactgtatatttagaaaaccctattgtctcagcccaaaatctccttaagctgataagcaacttcagcaaagtctcaggatacaaaatcaatgtgcaaaaatcacaagcattcttatacaccaataacagacaaacagagagccaaatcatgagtgaactcccattcacagttgctacaaagagagtaaaatacataggaatccaacttacaagggatgtgaaggacctcttcaaggagaactacaaaccactgttcaatgaaataaaagaggacacaaacaaatagaagaacattccatgcttgtgggtaggaagaatcaatatcgtgaaaatggccatactgcccaaggtaatttatagattcaatgccatccccatcaagctaccaatgactttcttcacagaattggaaaaaactactttaaagttcatatggaaccaaaaaagagcctgcattgccaagacactcctaagccaaaagaacaaagctggagtcatcacgctacctgacttcaaactatactacaaagatacagtaaccaaaacagcacggtactggtaccaaaacacagatatagaccaatggaacagaacagaggcctcagaaataacaccacacatctacaaccatctgatctttgacaaacctgacaaaagcaagaaatggggaaaggattccttatttaataaatggttctgggaaaactggctagccctatgtagaaagctgaaactggatcccttccttacaccttatacaaaaattaattcaagacggattaaagacttaaatgttagacctaaaaccataaaaaccctagaagaaaacctaggcaataccattcaggacataggcatgggcaaagacttcatgactaaaacaccaaaagcaatggcaacaaaagccaaaatagacaaatgggatctaattaaactaaagagcttctgcacagcaaaagaaactaccaccagagtgaacaggcaacctacagaatgggagaaaaattttgcaatatacccatctgacaaagggctaatatccagaatctatgaagaacttaaacaaatttgcaagaaaaaatcaaacaaacccatcaaaaagtgggcaaaggatatgaacagacacttttcaaaagaagacatttatgcagccaacagacacatgaaaaaatgctcatcatcactggccatcagagaaatgcaaatcaaaaccacaatgagataccatctcacaccagttagaatggcgatcattaaaaagtcaggaaacaacaggtgctggagaggatgtggagaaataggaatgcttttacactgttggtgggaatttaaactagttcaaccattgtggaagacagtgtggcaattcctcaagaatctagaactagaaataccatttgacccagtgatcccattactgggtatatacccaaaggattataaatcatgctcctataaagacacatgcacatgtatgtttattgcggcactattcacaatagcaaagacttggaatcaacccaaatgtccatcaatgatagactgcattaagaaaatgtggcacatatataccacggaatactatgcagccataaaaaacaatgagttcatgtcctttgtagcgacatggatgaagctggaaatcatcactctaagcaaactgtcacaaggacagaaaaccaaacaccgcatgttctcactcataggtggaaattgaccagtgagaacacttagacacagggtggggtacattacacaccagggcctgttgtggggtgggggaatgggggagggatggcattaggagaaatacctaatgtaaatgacgagttaatgggtgcagcaaaccaacatggcacatgtatacatatgtaacaaacctgcacgttgtgcacatgtaccctagaacttaaattataataaaataaataaatttttaaaatgcctctgtgattttgatagggattgccttagatctgtagatcactttggagaacatgaagatcttaacaatgttaagtcttccaatacatgatggatataaataaatgtcttaccatttatttttgtcatctttaattttttcagcagtatttgatagtttccagtggatatgtctttcacctcctcggttaattttattcctgaatattttatgctttttgatgccattgtaaatgagagtattttcttaatttcctattaggattattcattgttagtatatagaaatacgactgatttttgtttgttgattttgtatcctgaaactttgctctattcatttataagttatcactctgtgtgtgtgtgtgtgtgtgtgtgtgtgatctttagaattttttacatataagactatgtcctctgccaacagaaatcattttatttcctcctttataatttggatgcttattatttgtttttgttgcctaatgactctggctaggacttcaaatactatggataagtagaagtgatgagaatggcatccttacctttttcctgagcttagaggaaaaccttttaggttttcactattgagtatgatgttaatggagggattttcatataatagcccttatcatgttgaggtaatttccttctattcctagtttattgatcctatttttaaatcatgaaaggacactgaattttgtcaaatggtttttcaccatcagttgaggtgatcatgcttttccccccttcattctgtttatttagtttcttacattgatttctatatgttgaaccatgtagccatggtgtataatccttttaatacgctgttgaattttgtttgcaagtattttgctgagggtttttgcctccatatagactcataaaattagtttggaagtgttctctcctctataatcttatggaagaatttgagaaggatcatgctaattcttttttggatgtttggtaaaattctccagtgaagccatttggtcctgggcttttcttttttcagaggctttaattattgattcagtctccttatagttctattgtgattttttatttctttgtgattcagtcttggtaagtggtgtttctaggaattcatccattttttctaggttataaaatttgttggagtatacgtgttcatagttgtctcttatgatctttttttatttctgtggcatcagttgtagtgtctcctcttgtgtttcttatttttgttttatgagtcttctctctctctttttaaaataatcctagtaagggtctgtcaatttgttgaactttttttaaaaaaaccgactcttagtttcagtgatttttaaaaattgctcttctattctctattttatttatctttgctccagttttattatttcctttcttctgctagatttgggttttgtttgtacttttctttagttacttaaggtgcaaagttctattgttgacttgaactctttcttctttttttagtgtcagcttttacagctgtaaatttcccacttagcactgttttcactgtattgcatgggttttggtatattttcttttaattttcatttattaaagattttctaatttctattgtgttccttcttaaattctagtctcatttagacacacattgttttctttttgttttcatgcattgggatatgaaatcagaccacttttattttctgggaaaatgaaatgagaaagaaagacaccgggtgttgcccaacactatctagaaacaatgtacatttcatttgttttcatcatatttacattcctttattgacataagctgaaaatgaaaatgaaaaaagtccaggaatggcaaaacaaatttgcacagtacaatatcacatgaaaagggaatatacatatgaccccaacttgtttcctagttcacttggtccaacaatctgagtgaacaagggaaaaacatttcattcccagtgtttgacagactaagaaaaatagctttggcagaattatcctgcattcgaaagatatgatgattaggttgaactctaaaatccaataaaaatgtgttgactgtattaactaataaaagttcttaattttgcaaaatatatttttagaaagaaagctcatttactatggaaactctggtctcaatttcaaaactttgagcattttaattgtttaacaatataaagagttaaatcattaaaaataatgaatactaaaatttacttggtttatttaaaaaacggctcccttctggtctctaccctcatatagacatgttgattttatcatggtatcatctaaatgtcatcaaatgacatgaaacctaggtttctgagtgatggaaaatgaatttacagctcacacacacactctgggaagtcggcctcacttgacaaaggcaagaaaggtggaaaaatgatgattttgagacacagaactactaccttcaaaaagtagtgtgtctaattactgtgagctgtgtgaatcagggagagttagtttagacatgtggctctatacatgacaccaggctggttaatttctattataaaaaagtagagggcaaactagagatgaagtcataatatagtttaacatagtactatgcaaaagctgaaaattatgttgctcttgcatttgaattcccagccatatatttcttaaaggaactagatatctagcacatttggcaattaactctataagcattatcgacactcagtaagagaagagtggaaatattagccattgtctattataatcctagcaaatatggccttaatgaaggaaaataatgtggtcacttatgaacaccttttagtatgaggaggaaatctgagaaattgctttagtaaaaattatttattgagtacattagacttggtgctgaggataatgcagtcaataagacagagtccagttactaaagagctgatttgccaaaggtggtcccataaataccatacaaagagaaagaatctagaggactgaggcagcttaacttcctatgcaaaaataaaaaagtaaaaccaaggctcaggattagagctataaattaatacttcacacatgatacagtttggatgtgttcccatccaaatctcatgttgaattgtaatccccagtgttggatgtgggacctagtgggaggtgattggattattggggctgatttcacattaatagtttagcaccatcctctcagtgctgtcctcacaataataagtgacttctcacgagatttagtcacttaaaagtgtgcagcacctccccactcactcactctcctgctctggccatgtgatgtgcctgctcccgcttcccttttggccataatcgtaagtttcctgaggcctccccagaagctgagcagacaccatcatgcttcctgtacagcctgcagaatcatgagccaattaaatcttatttctttataaattatccagttgtgggtatttcttcatagtagtgtgaaaacgtcctcatactacatgataatattcagtatttatccagttataagtttaggacaaatatgtgtttttgtttttgtttaatagagtcaacttggtctggaatctgtattagtgtatttttacactgctgataaagatacccgagactgggtaatttacaaaagaaagaggtttaatggacttacacttccaagtggctggggaggcctcatgatcgtggcagaagacaaggaggagcaagtcacatcttacatggatggcagcaggcagagggagagagcttgtgcagggaaactccaccttataaagccatcagatctcatgagacttatccactatcatgagaacagcatgggaaagacctgcccccatgattcagttacctcctactgggtccctctcacaacatgtgggaattctggatgagatttgagtggggacacagccaaactatatcagaatctataaaccccccttataaaactatgagacttattcactatcaagagaacagcacaggaaagacccgccccccatgattcgattacctcccaccagttctctctcaaaacacatgggaattgtgggagctacaattcaagatgagatttggatggagacacagccaaaccatttcaccttatttatcttttttgatctttgttggcttaaagtccattttgtctgaaattaaaatagcaacccctgcttttttctgttttctgtttgcttggtagatttttcttcagcccttattttgagcatacagatggcattcgagatgggtctcttgaagagaccctaccattgggtcttgcttctttatccaacttgccataatgtgccttttaagtggggcatttagcccatttgctttcaaggttcatattaatatatgtggatttcaccctgtcatcatgctattaattgattagaaagcaggcttgtttgtgcattgctttatagtgtcactggtctgtgtgcttaagtgtgcttttgtagtggctggcgatgtttttttcctttccatatttggcattcttttcaggacctcttgtaaggcaggtctggtagtaacaaattcccttggcatttgcttgtctgaaaagaattttatttctctttcacttatgaagcctagtttggctggatatgaaattcttggttggaatttttttttctttagaaatgctacctaaaggtccctcatctcttctcatttgcagaatttctgtggaaaggtccactgttagccttatgtggttccctttgtagatgacctgccccttctctctagctgcctttcacatttttctttcattttgaccttggagaatctgatgattatatatcttgaggatggtgtgtaatatctcgtgggggttctctgtaattcatgaatttgaatgttggcctctctaagtgaggtcgaggaagttttcatggatgatattctgaaacatgttttccaagttgattgctttttccctgtttctttcagggatgccaacgagttatagatttcatctcttgccataatcccatatttcttggaggttttgtttgttcttttttattcatttttctttatttttgtctgactgagttatttaggagaggcagtctttgagctctgagattctttcctcagcttggaactagtgcagttgtttgaaagaaaaaaaggaactctggcttttttgctggttctttcttgtgctggttctttctcatttgtgtgggctgatgttccttcaatctttgaagtttctgtccttttgatggatattttctttttttctttgatgcccttgggggtttgattatggtataagttgggtttagttgacaggcttcaatattagtctgctcctgggtcttggaggagcccccccgattactgcctacatgcctgtgcttctttttttgggtgttttgatccgcaggactcccttaggcagggccaccattggcagatatgctgtatccatgccaggtcagccctaatctgctgtctgtgtgctttctggggaaacacagggttacacctgtccacagagttcaggtggaagtgggaccgctgggttggaagttctagcaggtgtgggccatctggctatgagaggtgggggttggtggggctaccctccctgtcatgcaggtgtttccggggcaacaggaacctgtgccgctttgcaaattcaggcagaaataggaccaccaatctagaagttctagtggacatggcttatctgggctaccagtggcaagggtggatgggaatgcctgccctgctgtctagatgcttcctgggaaaacaggaggctgcacccactgtttaagttcccacagaattaggaacactgggtcagaagctctggcagctgttgacagcctgagtgccagtggccagggtgggtggggtcacatgctctgttctcctggtgttttacttgttttgcttataaagggaaatgttcattaagattctacctttagctgggtgtggtggctcatgcctgtaatcccagtactttgggaggccaaggcaggaggatcccttgagcctaggagtttgagataagcttgggcaacatggccaaattccttctctacaaaaaatagaaaaggcatggtgtacacctgtagtcccagctacttgagaggctaagatgggaagatcatctgagcctggggaggctgaggctgcagtgagctgtgattgtgccactccactccagcctgggcaacacagcaagatcctgtcttaaaaaaaaaaaaaagaaaaaaaaagattctaccttgaagctgttttcctggaatgcatctaaatgggagagtccagtttgaaccagtagagggcagaataacatttagcattcatcactggaatgtgtttgcacatgaggtgtatcaacagtaaggaaacaaaataactctagatattcatgtgtcttagtaagtacatttggttaattaacataaggccatgttatgttcatcattaatgaacccagccaagacttttttttttaaccaacactcaactgcttaaatgccttgctcatcaaagagacaccagagaacaaagctaagttataaaaaataaggatggaaaagcttccaaatatcccttaaaaaacaattatattggaaggtctaatggggtcagattagataataaataacaatctagaactagtattaggctaatatcactgattttatgcttaccttttaaaactttattctgtgttatttatttattctagattcccataaatatatttaccacttaaactgaaagacccatagaagacatttttaaaaattatttccacactagtttttccaattgataaggtgatcagtaacatagatttttgatccaactactgggaacaatttaaaacaatctgttcatcaatattgaataagaaaaataaactatcatctcaaatattttgatgagatatttgcaaagaaattatattcagtcataatttctaagacttcaaattaatgagaaacagatatgtgcaaatgagatcaggcatgtttctttttaaacaagtgaaattataaacaaaaatattcttctaaaaaattaggtaaaaggcagcaatgtctactttcccctgaaatatttaatattgtggtgaaataataacaatgtaaaacattatgaaacaagcaagaggaattaaagttataacatgaagacaatttggtcatgtagggtaaaaataaggctccttttgttccctcttaatgaacatcacatcataaatctagccactcttgtatcctcctattaccataaattggtttttgaagtttctgaactttctataaatgaaaacacattttagtttttctttatatttagctttttcactcaatgttatgtctgtgaaatcatccatactgttcatgtatgttgagtgtgttgtttttttcaagttttatgagccatttggatagtctcttttgtgaaattcctgttccaatctttctttttggtaagcactttctccttttcttattgatattgatttctctttttattttagttatttttatatatatcctagatacaactactttgttgggtaaatgtattgtaaataacatctttcagattgaagctgatctttttattcacttaaagttattaatcttaatgaagactaagttatcaaattttatttgatggttacttcacttttgtcctatttaaggaaacactgcttacagtaaccaagtacataaatatcatgtcatacagatatgctcttatgttttcttctagcatttttatatgtttagcttttgcatttaggtctatgatgcatctttattgtacatagtgaggtgggagtaacatggatattcagttgacacacaacatttaagaaaaaccttctaggcttattgaattgcagtgacatattaattacaaatcaggtgaccataaatatggcctgtattttggctctatgctcttctactgatccacttattttttatctttgtcccagacagactagcttagtattactcttctggatttgttcttttctttaaaacttgtctagcctaggtcttttgtactccagtgtaaatttcagaattttcttgttaatttccatagaaaaatctgttacaattttattgagattttttgagaaatcaacatcttaacaatattgaaacctccaatccattaacattgtatatcctgtcttcttcaatctgtgagaagcttattctttgccctttgaatgttggtcatatagtggtcattggccaggacataaagaagcgggctgatgcctatccttgtttttctatagcctcatctctatagacaacattctgtccacaagtgaagaacaaagccagaagcaaacaggtggaatcctcaggagagtctttttgtaataaggagaaagatctcatatttgatttttacttctgacaggctctctggtcccatcccacctattcccctaccctaccagctgtgagaccaacaagagagctgggctacacccaacttctgtcccctcatacttgtgagaattccaaaccccgcagaccctggtctacttgggggaacccgatcacagtcccacctcctaacagcatgaagtttcaagctatgcatactacctgactctttccctttaatccctgtaaaaaaaaaaaaaaaaaaaaaaaaaaagaaaagcaatagcagcaacaacaaaacccagtctctggcaaaatccagattcagatctaaagaaaatatattaaaaaaaatttaaaaaaacattgttccagtgcatgtgagtagtaaaatttcaaacttcattggtaggcaaatggcaccattggattggtctaaacatccaatcattggtcaagggttgataatctctcctaggtgaccacaaaacacctccatatggagcagatccctgagagaagttttctaattataacaggaataacttgtttcacaattcctttatacaatctcctagagcagtggtttccactttggcttcactttggaattatctgaaaagttttaaaaacactgatgctgaagcgcctgcttattttagaattaaaaggaattcttaacaattaaaaacaatttttgacaagggaaatgaaaaattagaaaatcaccaaaattatttttgagactagtataaaactgattatagaagagggctgaattagaacaaaacaaaaaaaaagttactacagatagaaaattatctacgtatagctacaagtaaaatatcagaaaaataatctagagacaggttaatattaaatcttaattgagtattgtttttctagaaatccaagaattctaaaaaaatctgttactataactcagtggattaagacacatgctcaaaataaagagctatatgaagttcctacctggaaactcttaatggtgcaaaaacattaattgcactcagactggagatgtgatgtgagagaaaatgaggagtcaagaatgactatgtgagaacctataaatgtgaactgcaactaacagaactggaaaagaataagagaaatcatttttcccccaggagattggttttgaataaccttactttgagtttaggtctaaaatgaaggtttcaaatggagagcacttggatatataattttttaacatgggaatgacttccaggctaaacatatgcatttggataaaatcagcatgggggaaagtttaggaaagagacctatgctaggagatgggctgtaccttttgctccacctagggcatagatcagcacaagatgatgcctctgctttcctggactcattcttcctccccctatgtcctttcctggacccattcttcctgcctccttttcactgtgaaaaactctattgactttaaattctttccagttattttcttttcaatgccatacatcatcatggccaagaatcaatcaggaaagctcactatattccttagagaaagctcctgtaatcagaaagcctgtgaatacaactttattgatcatttctgttcctattgctcattaataaattttgtcccttttgtcttttcattgtacatatattcgtacaatacttgcgtataagttaataaatgaaaggaatgaataaaaatttttcaaaagttacgattcagtcatgttttattcaattatgtgtattatattgttttagtcaataatttcattgtaataaataatttcatttatacaaattatttatgttaggcaacaatgaacttttacaaaattgtaacttgcgttaatttagaaagcagattatatgcctactgagcttgtacctctaagggtagaggttgaaaaacgatattagtagtaggtgtgaaaaattgttgactgcatttggcaagtaactttagaaagatatgagttcaagaaagtatttttcagtatgcaagcagagagctaaaagagaatcaagggaattcagaatcctacgagtaggatataaaaactgctgtgtttcccattcatggcaattctgaatgcatgtctttgttgtgatcattctacattcagactacacagagtcatatccagctattatgaagaggactccatatgacccaaagactctgagctttgagctggatggaattactagaaaatactttggattggtcccttcaagttagaataagcgtgccgtacatggggggcaaagagaaacattaatatttggtgacctgaaggtcgatatgtagcaaagtcactgctggtgagcaccaaatccaatttattttcattttggacacagggctacaccctgctttccttatagttagccaaggacatatgactaagtttttacctatacaatatggacagatgtcatggccctctgatggcttggctcatgtaaatttctcatgggtgattctcttttctcactttccattctatggcaaccttggacaccacatattgaagaaaatggaaagggcctagcatttgaatgtacttgatagagcccattcatctcaccattggcccacataaatctgacataggaattacatttggaaactggaataacatgctttgtctcctagagatatggtagtcaataccctgaaaacccaggaacaataccccacccttggattaatctggatatccattgcccctgccaaggtgtcaccaggggaagaggttattgaggacactgctactccatactattctatatcttccctcctctctttctctgctaatgaatgctacccagcaccagaaaggcctttatctcacattcctatgtgataggaattgtggctattcctcttcttcccctttcctatgtacatttaacttctccttccctagggagaggagggagagtgggttgggaaagggagtgaagagctaccaaggaaaaatcagatttcaaagaatagaaaatatgtcaagatatatttcaaatatattacttccagttaaagcataaatccattggtagaatttatgcctttaagccaaaactatgggttttcttcagatcataagtgaaataaaatgactttaccaaatgctaataagttgtgtctactcttaaaaatgacacaaaacaagcaaatacttcaagtaacatgcaaataagctacagacgtaaataagttccttaccttctgagcttcctgacctcgttagtctaagaacatcacaatgggcttcgagattattgtcatgggaccattcttattcatccaaaatgcctccttcttagaggtctgttttgggttcataatccctacaagtaggaaatcttttctgactctgtaccaaaggaccttttctcaatatctttcttctataaggtacattcaagcagttttttccttcattttaatttaatccaagagtgtgacttcctactgaatagagatttgtggagaccttgctgttgtaacttattcagcaattgctggatcagctaaagataagtttagagcaagctgttgggttaaaggaggctttcttagtgcaaacttttgctttaaagagaaaataagtcaatatcacgaggtgcaaaaacatagctccaagatctagaatggtgctagagaaaaaaataagaatgtgctttactcatccataaacgactatgaaaaaaccatatagtaaagaggacatcaatttccaggaattggaattttaattatttctaaagctctatcactgtgtttattctttaaaagagaaacatattaaaattctcatatttacttattagaaaatatgatttttatccaatattctatctgtttcaccttcactttttaatagtggccagtgaagtggtccctccacgtcgtcccctggtgataccaaaggcaggtgttgtcttccagtaccaaccacagtagaaactaagctatgataaatctcccttgcttcatgaaaatagaaatgctggatacaatccgagtcaacttaaatggatagttaagaatttaaaaaagagaaaacgagatatttagtttccagaaattaaaagagaattttaaaatttcatttctaccctctgtttcctcatcaatgtaatcactcttattccttaacttgcgttttcactcagcaccattcaacatactatgaacaagtttggatgtaaatgaatattctttacctaattagactgattgactgtatggtattctgtaatacaaagggaccattgctgacttaaccaatcctctataatagcatattaatttcactacaactgtcttttgtataaataaggcttcaataaataaatttgtatatatgtttgagctggcatatggacagtgtttttgtaatataaatacctagggctgcattttctgggtctggtggtttaataattttggtagattttactaaattaactataagtgtttttaaattttatacttctactgtatctactcttaccccaaccatcaccaagtaatctttttgttgttcatcagatctttcatttatttgaaatgagaggcatattatttggcatattatccactcacagctatttaggcttcttgtaaactgcctctatatttcttactcatatctctatcaggttcttaaaatatttgaactttttatttaaaatattaatactcacatattttaagggttttttttccatgtgatttgaattttctttatggccctttgctggatagattattttttccatttaatgtgttaaaatgtatttcttttttccattgtggccatagttttcgtattactcagaaagagctttcctgtctgaagatttaaaaatgttttacatacacatatttctagtatttaatagatttgcatttgtttcctacattttggtatactaggtataatgttttctacttattgagcatgccaggcattgttctgaagtgtttataattcaattcatcctcgtaaccatccaatgatttgggctgtttttattatactcaagagctgaatgacctgaggcatagagaagcagaataacatgctcacttctcaggagggaggcttctttttgtttcctatctctaattcctctaggtgtccatctactggtgaggcccagtaagaaatttctccatccaggtttcatctcaactagcatgagatctctgtgtcacaaaaggcttgaatatctgctggtgctattcgcaggggacacagtagcatgatcttttgtcggcaggtagctatcttccatcagcccctaaggaaatctggattctttcctgtcttctagtcatgacagaggcaagattctcatacaggcacttgaagatctcattcttgtccagattgtaaccttgagcccagtcaagggagcaagtgggactggagcagatttaatactccagtaggggtatatctatttcttcaaaaacatgattttattggatataggtttcacagctcattggctgtatatccaggatctgatgacatcatatgaattgtctagacatatttatataatggattatattttacattttttcccacgtactgaacatccttagcttgagcctaaactgtgctgtccttggacttagacctgtctggacttgcatcatggtcttagagtgggtttgttgtttatcctaaaaaggaacccattctaaggaagaaaagagttatatccacacctggtccagtcacaataactctgcttagcagtagaaggccaactttgacaaagccatgggtgtaacactaaggttaccccttggctcaaccttcatagctatttacctgagtgttgagcacgagaaggtcatttagtgttttttattttttttgtttgatttttaatatgtcaggcattattagtagcagaagacagtacatggcaatctaaaagagatgatttagggaaaaaaaatcttttatctcaaactttgcactctactctgtgtgtgtgtgtgtgtgtgtgttcaacatcacatgttgtgttttgttttttcagccaccttctcccaccctccccaacatacatgccctgaaaccctaagccctatggctcccactgcccagtaacccaccttccctccctccccaccacaccgtacgtgttttttgtttgtttggttttgttttattttgtttatgttcaacccctcagacagtcccaagtgctccaaggaaactttgtgctagaaattacagcatgaacctactagtgaagtctctaaaatcccttcttgatgagactcttaatcttgtgtcttcaattacaattcctgcagactgctgcaacataaatgctgaaatgtacagaatcctctctttgcctctctaatttgaacccataataagaacccacttagccagaggcatttcaggtacatttttattattttagttatttctgctcctgatctctatcccatccacagagtgtattatctttcttttccccctctactaggcacaaatgggtccttcaaagtatgtctcctcaaatcccaccattgagtctggaaatatgcttatttctttccaatttcatctagcctctttctcggatactcattcctccgtctaaagtaatgagagtggattaggaactattacttttttaaaaagatctgatacactgaataatacaccagctaagaattcaattctcagtgctttcaaaataaattcactttgatcccaaatgttttcatacagattggtaactgcattgttcatcttagagttaattacttagagtaattaaattttctccaaggatctatattttattttgtgtaaggcttatattgaaacataacttggaataaatttcactaaaacaatgtatgcttacctctcttatgtagactaaagttacatgatttattagtcaacggaatcctgtcctttgttctatttaaacctcacttcatcctttccaagagataaacatctctacctaaattgactgaacagcttttcacacctctaagaaactggattctttttgcattgaaggcaaaattcataggactgttattgtgttatggtcccttcctgcatacttactacgtaaccctagctacttacctctaaacacttactacatgctggctatcttctgcctactcataatgcttcatgtataaaatccaaagaaatgaagaaaattgccaccaaatctttattaatagctagtggccacctattttggacaacaaatgagtggccttttgactagaataatgggaagagtgttatattttataaaattgtaaaattgagccatttatgccattggcatgtactgttctaatattttcataatttaagtttttttaaaaagctgagcaaaaaacagatccttttagaactgctcaagatggtgctaatggtttctgtattacctggcagttgaagatataaccaaccatcaaccccggctgactgggaggaaagacacatcataagagtggggtcggcccggcacggtggctcacacctgtaatctcagcactttgggaggctaaggtgtgtggatcacctgaggtcaggagttcacgaccatcctggctaacatggtgaaaccctgtctctactaaaaatacaaaaattagctgggagtggtgacaggcacctgtaatcccagctacactggaggctgacgcaggaaattcgcttgaacccaggaggcggaggttgcagtaagccatgatcatgccattgcactccagcctgggcaacaagagtgaaactccgtctcaaaaaaaaaaaaaaaaaaaaaaaaaaaaaagttcaggaaagcattgtctaagatgatcagaaccattagttagaagagaggctcccatctggacttctgccctacacattatgttcttattttattgtgcccttgctatataagtgtaaaacccaccatttcactggaaaaagataaatacttcatttttcactctaagaagtagcatatctaaatggtccatccaggaataatggagagtctcaaaaacaaacatcagaacttaacttcttagcacaccacacaaacaagaaaggcttcatttctagacagtctcctcatatgtctaattggccatgacaatatggtactggtatctcccttctttcctttaatgctatattttaaaaagtctgcattcattcaatatttagagtgtccctgttaaatgttgaataatgtgctaaagagttaagaagccatgtccttactacaaagtaggtaatactctagttggaagaaagagaagtaacccattacagtacaatgaggtcagtgacatggtaagatttgtgctatgggcaagtagcaaataggttcagacaaatcagactataaaggctctccgtgaagggaaaaattttaagtgaatcatgaataacagaaatgttattaacacatataagggaaagaatatgtagctagcaaaagaaacagcttatgagcttaggttttctgtggccctaaattgaagctcagacaacaaattctgagatgaggattcttatgcaagtttattggagagagctatggaatcacatttgtgagaagaaaaggcaggacgattaggcaaaggggaaagctaacctgcagtgtagtcacaaaatggccttagccaataacaggaggctgggagggtggtctgaaactgggaagactcttcacaggtggagtaaggggacttcacacccccacgtagaccagtcattgaatacaagcagaccctagggaggagtagaaaacttgggctaaatgactttagccaaaggcaattccacaaatggcccccaactctatttaccaaacatttatacttctctatagaggagatcactggataagtttgccatttttcaccttggaatgaatcctctgtcctccagagtttggttttgtgtccacaacacattctttgtccaatcagcattgctatcgtggaagttttgatttcactcaaccacacggtatgaggaccagaaaccttagagaaaacaaaacaaaacaaaacttgctttagtccattttccttaaaaggcagatattgtcatggggtgcacctaggatatgacagttgctacatacagcttctttaataaggaaaatgtctgatttgctgctgtgaaaaggcagtgatagaaaaaaaatatatcttcatcaactaactcctatctagggtgctaacttttctccagatgtcataagaaatatgagatcagtagccttaaaaaaactatgccttcatctcttaaaaacttaccaaggctatcaagaagtaggggtacggcttactacgtgtagtcacaagaccagcagcaacagcatcatgtgagaactgttagaaatggaattactcaggccataccacagacctattgaatcagaaacagtgggatgggaccatgcaatcagggttttaacaaatcctccaggtgattctgattcatgttagaggtgggacttaacttacagcaggtgccctttacaagagttgtttttaatttttaaagtagagatgggatctcaccatgttgcttaggctgatctcacactcctgggctcaagcaatctgcctgccttggcctcccgaagtgctgggattacaggcatgagctactgcacccagcctgttctttttttaaatttcaaaaatataataatttttttttcctggttctaaaaggaatccttattcatgggagaaatatttaatccaaaaagtttaagtgaatgtaaattctatcccaaagacagtagtactatgaacattttcatgcatttcttttcatatacttttcatgaatgttttatttgtagaaaatatgatgatgctgttattattttgtaacctgcttttggatttaatgatttgtttagctcaatacatatagatgtaacaaaaatataactcagcctgcaaatacaaatgaacctacccatactccaagcctttccatgtgctactaagccaggagtccaatcttttaatacgtctctccttcccaatattcccaagtttagaactctggttttggagttttaaaagggcacacatatttagaagtaacaattttttattttgtgctaggcattgaggtggttatacaacaggatatcaacttaataaacctaaatgtttgggaaaacattagtatataaagtattagtttaaacttctaaatatgagtattattttctaaacgtttccatttgacagttcctccattctgttctcagttcttaaggaagcaatgtcaagagaaaggaaaatatcttttctttaattcaagacttcagagaccattgtaaacttgaataaagaaagctaggagaaaattattattattgttattattattttgcagtgatatttcacaatgctattcaggtttgagttgtcaacaacacagtgcaggcttttgagtcaggctgacttgggataagatctttgctctggtatctgcaagctctgtggcttgctacattactttgagcatgttatttcacctttacagtcttgttctcacttgagaaaaaaataattacagaaggcacttggtaaggtcaatttgaaaattggataatgtgttaaatgaaggatttggttccaaaaacttcctggtttaaagaacaacaaaaaattttctagaccatgagaagaaaagtaacttatatttgcagttccttgtggtatttctccttcctccacttcactacctttgtgtgaatttgaaggtaaacagatcaacccctggctgcaatgtgaagtcagcaaagacttgcttctgattgacagcctctgcttccttacccttcttcactattgcaggtgactgtctcactttcaggatcctattcggttcctactcttccctttcaaaccaagtctaaagtagcagccattactcatttgcattaattaaactgaactggagtatgcttcgttcctaagtttttacatttactactaacttttacctccaattatgcaatgcatctgacgtagaacatgacacatggtagtagaactagcatcagagttttgggctgtggctctgctcccttacagtggacgaaagtgggatagccaccaagcctcaactttagtttctctgcccccacgttgttccgtggtgacttctgagagttcctggctagaagagctggaatccctccatcactggcatctcccaggagcaggaaccctctcccttggcacgggtgtgcttctctccagccctcctccaagcagacatcccaaccaggggcaggctaattcagtctcctgttccttttgaccttcaccagccagactccctcatgcatatttctgataactgtgactcgttagatacattttaaattattatcttaatatgtaatattcacacaatttaatataaaaatttttagaggagctataaaatctctcccaccctaatctccttcttcagtcttccttcttctcctaaatacaggtaatcattgtaatttatttcttattctttatttatacacagtaaggacaaacgtaagttttatttaacattttcaccccaaatgtagcattttatgtacactgctctgtatcttgcctattttcaactttttaaaaagaaataccgtctcatttgtttctccagctgaatagtgttcctttatatgaatatgcctcaactgtctctaattaggaaaatcgagatggtttcttgacttttggtattactaatagtgctgcagagaataatattgtttgtaagttatttcacacgtgggcaagtttttgttgttgtggttgttgttgttttgttttgttttgagatagagtctcactctgttgcccaggctggagtgcagtggcatgatctcggctcactgcaacctccacctcccaggttcaggtgattctcttgcctcagccttccgagtagctgggactacaggtgcccgccaccatgcccggctaatttttgtatttttagtagagacagggtttcaccatattggccaggctggtctcgaactcctgaccttgtgatccaccctcctcagcctcccaaagtgctaggattacaggcctgagccaccacgcccagctgtgggcaagtatttttataggacacatttccaggcctagaatttatagatgaaaggctacatgcatctgtaatagatatcacctaattgcctccatagtggttgtactataaatggcatgcatgctatttaatttgtatttctattatcatgagtgagattgaacctcttttaatgtagttttttttctctgcaaactgttcatgtcctttcaccatatttctattgtgtctcctgtaatgtaaatattcactgtgtaataatattttcaaatcttaaaatgcaaattattcccaatatttctcattgtctctagcaatttctggcaaataagcaaatcattgcaatggagttctatgttaaggaaagtatttttacattagtggcatattttattgtatctacccagccagcctgtatgaaaatacacccatttgaagaatcaaccatattaatgaatttattttgacatacaaacaatttaaaatggatagaatatataaagccacattacaaaataaaaacaattgtggtcaatatgcacaatcttaaaacacagataaatatatatatacacaaaatcaaagcaatgtgattgtactataaattgtattaccactctatgaagaatcatgtctggagaagtcctctagtccctccacctacctcgggcttctaaactctgtagtaagctcttgcttcatgtcgttcaagggtcttccttgtttgctcagtttttctgtgagactgaacacaaagaacagacatcggctgatttctacttggacaatggcccaggcacaggtgctgtagtcctggttttccaggtaatcatggatccttcggaagtacattttaacttgtaatctaaggttatcactacccaaagtaccacttagcttctctgcttccagtcccatgagtgcttctaggtattctagctgttgatgaagttgaatgaggaatttctccgtgtggttttcctcccaaccatccagagaaatatttgccctgaagaggctgaagatctgctgaagcatctcatggagaatggccagagtgtgtcctttttggtactgctgaggactcaaagacttctgaggaagcagaaagtttttcctgtgtggtagacactgctgaattgacaaggtttgcaacttattcaagagttttaaactttcttgattcacttgtctttgctggaagataatcagtttcaaatctagagagaagatagtggtagaggccagcagcaccaacacagttccaaagaagtgcttgataatcatggtgaaggtcaaatatgctacttatccctgcatagacttagggaaattccagctctagtgaatgtttgcctttcatgcatctcagattattttggagagtgttctcttttgttgctttcgttttctaatgtcatttctccaagtttacacattagattttcaggttcccttttcatggtgttcagagtacattttctccatttccctattgtgttggctattttgaggaagtaccaaaataacttattcattgtatgctttccttgaggcaattacagactagtcatccaacataatcttttattattctattcattatatacaaagtttcactgaacacaatgtgctttctaaatatttagtcaagcttattaaagttcttttattgagattacgtttttttcagtaatagtctttcatggagtaaaacttaccaaaggcttatcagcacctataaagaattcaggggcaaaacttaaaatacctacaaactactaaatttaaaacctcaattagaactgtaaattgtcacaaatgcttgagcaaataattaattttaaaacatatatcagcaatcttaaattattttatatcttatcctatcagtttaatatctaagattctagcctatagaagcaatgcaaaaaaattagcaaaagaagagtgttataatattattgcaaagcagaatattagaaacaacctataggttcaacgacaggtgaatgattacatatatgttggtacagccatataattaaatgatatatatccattatagatgacaaaattatatgtgaagagagattgggggcatttggttagcgtatattccctagaatagtgatagctctggtaaactaatgtgaacatctctacattaacaatgtcctttgaattacaaatacccagttccatattctaagttcctcttgaataagcccccaatatacctttccaatcttatcccactgttgctctaaatatagtgtgaaggaatctgaactccagataaagtaagtgatttagtattcccttaatacagctagcacttgtgtgtgtgtgtgtttattgatgatgctttctctgaaacatcaactgttgcctcctttacctcaagaacctttctgtgcaaggactaaagactacttgtcctttaaggcccagatctcccccaaggagccataatcttctggatccccacaacactttgtacctaccttatttaagacacctttcttgttctgtcttatacttgactatgtacttacatgattaaaagtctcttcagagtgtgaaataaacactgattactgatttctttgctgtctatacaactatagtagttgcttaataaatatgtgttgacttggaataaattaatatgttctacacaaagtaatacaagatgttgagtcttatctttaatcatttctctgcaggcagctgggtgaatccctaaatgtcaaaaacaggcactctgtaaacatgtatggtctcattatataccagctcagctgtatgtttggtcacttagtctagtattaataagttgaaataaactcagtcagcatgctccacagagggtcttttccctccctatctgagagagagagagagagagagagagagagagaaagagaaagagagagaaaagacatatgataatatataatatacgaaaggaataacacttgtttcataacattatgctcaatctatctggaaagtagaattttgactagtctcaaaaaatctttaaatatttaatgctgagcttcgggaaaacaatataaaaataaattaagaatatcagaagttactccatctaataacaacgagctctgatctataaggctttctcatcattttcattcaattgacaaaaatgatctaaatgttgtttaatttccaaatgatcagggattttccagatgcctttctgttactgatttcatatttgaatctgttgtggttaaagaatgtagtttaaatttattgagacttattttatggcttagaatatggtttatcttggtgacagttccttgtgaacttgaaataataatgttctacttttgttggttggactgttttataaatgtcaaataggttaagctgattgaaagtgtttgaaattttctgtatcctttctgatggtctatttgttctatcaactatcaagacagaagagctgaaatccctagtataattttagatttgcctatctcccatttcagttctatcagtttttgccttatatattttagaactttagtattaggtgcatcatatttaggattattatgtcgtcttgatgaattgacccctttattttaaaatgttcctctgtatcctttgcattattccttactcctaaatcaactttctctgataatcatttctgtttttttaattagtgttagcataatatgtcttttattgcatcttttaatttaacttattcatgttattatattaaagtgagtttcttgtacagagcgtatagttggaccttgtattttattctgtctgacaatctttgctttattagagtgtttaggtcattaaatttaatgtaattgtcagtatggctcagtttatatctaccactttattgtttgttttctaactgcccatatgttctttttctcacttttaagcttttccttccttcttttggattgaatttttgttgttgttttctattgcccattttatctccattattggcttgttagtaataccactttgttttactttttgttttcatagcagtttctctaggattaaaaatatacatctttatttaacatattacagtttaccttcaaataatattacaatccacttaaggtacagtgtagggatattataacagtatccttatatttcctctctctcattctttacactactttcactaatatttcttatattacacgtcccctggaaataaactctcttggcttttgtctgtctgaaaaagtattgtgtcttctttttgaaatatatttttgctgggtatagaattctaagttgatatattttttctttaagaactgtaaagatgttgctctactctattctggcttgcataatttctgaagagaagactgtggtcattcttaattttattcctctgtgcataatgtttcttctttttctctggcagcttttaagatttactatcactattttctagaaatttgataataatgtgctttggtgtgattttcttcttgtctcttttacaaggttttttttgagctttgtgaatccatgattttatcattttcatcaaatttgaaaaagtttcagactttatttcttttaacatttttctattaccattccctccttcctaatctcttctgggactacatctctagatgtgtttgactgtttaatattatcacacagttccctgaagctttgctcatttactttttagtcttttcctctgtcttatttctaatagtttctaagtctgccttcaagcttattggtatttcctttggtagtatcttatctacagttaatcccatccagtatatttatcacttcagatattatactttcatttgtagaagttgaatttgtttctttttcatatctacatttctttcctcatcacattcatcttttcctctacattcttgagcatatggagtacatttatagtaggtgtttaatctccttttctgataattctatcatttgtgtcatttctgagtctggtcttgtcaattatatttctactctttatgggtcctattttcctatgtcttttgcatgtttggtaacttttgagtggattctgagcattgtaaattttactttaatgggagttggatttgttaagtcctttacgtacagttgaactttgttttagggtatagttgagttacttggaattggattcctctgacattggctttgttagcatgagtgaagcagactttataatttagggcaatgcctttgtaaccaagaatatagtcttttgaggactctacttaatgctctctgaatttggagatttttgccctctggctgctggaaacatgaaatatccccagccctgtgttagcactggggacagcctgtactgcctgctcctttctgggtgttcttttcctaatcgggtaactcctttacgcacatacacaaaccacacattagctaaagactcctgaagacatttttacagatcttcgtagctctcattcattcttccccaatttccctctgtgcagcaatatcttctccaatatttttctgcctccctgaactccaaactatgacatatcaactcattgagaacactggtctgttggagtttcctcctctttgtgctgcagcctgccaattttctatccagcattaagctggagcaattgtagggcttactgtatttctttcctttctctcaaggatcattatcttacgctgtctgttatccaatgtctaaaaactatttttcgtatattttactcagtattctagttgttcaaagtgagatgataaatctagttgtccctcatgactagaagtggaggttctctcattataaataatctaaagtgggagttggcaaactatagcctatggaccaaatctgtcctaccacctcctgcttcttctttttttttttttttttttttttttttgagatggagttttgctttgtcgcccaggctggcgtgcagtggcttgatctcggctaaccgcaagctccgcctcccaggttcacgccattctcctgcctcagcctcccaagtagctgggactacaggcgcccaccaccacacccagctaatttttttatatttttagtagagatggggtttcactgttttagccaggatggtctcgatctcctgacctcgtgatctgcccgccttggcctcccaaagtgctggaattacaggcgtgagccactgcatctggcctaccacctacttttgtaaataaagttttactagaacacaatgatgctcatttgttatggcactttcatgctacaatagcaaggctgaatagttgtgataggaactatatggtctacaaaacctgaaatatttactctctggtcttttacagaaaggtttgctgaaccctgatctaaaagattaaaaacaaaatataattgtattcaaagtctagaaattttgaaaatgttttcacaaaaaatgtaatctaaagtaaatgttaaaaatattacatattttatattttcaaaaaacatgaaatattttatacaatgttatctatcaaaattaaaagacaacatgtgtggtataattaatatcaaatttaaactgacagtatttaaataaagcatatacttaaccttttaattaaaaacgtattaagcattaaaaatgtttataaaagtaaaattacatgcaattctatcttacaaggttcatatggataacaatgtaaaaaaaaatgtatcacacttccagcatatgtctagaccaacataaattaagatttaagagtaaaataaattgattaatattgagaaatattttccagcctccatgtacaactattgccaatgcccatcataatttatgagtccctcctgaatcactaattgttttttttttttttttttttttttgagcaacatggctctttatttcacctgggtgcaggcgggctgagtccgaaaagagtcagggaagggagataagggtggggccgttttataggatttgggtaggtaaaggaaaattacactcaaagggggtttgttctctggtgggcaggagtgggggttcgcaaggtgctcagtgggggtgcttttcgagccaggatgagccaggaaaaggactttcacaaggtaatgtcatcacttaaggcaaggactggccatttacacttcttttgtggtggaatgtcatcagttaaggtggggcagggcatgttcacttcttttgtgattcttcagttacttcaggccatctgggcgtatacgtgcaagtcacaggggatgcaatggcttggcttgggctcagaggcctgacattcctgccttcttatattaataagaaaaataaaacaaaatagtgaagtgttggggcggcaaaaatttctggcgggtgatatggacagagaatgggcgatgtttctcagggctgcttcaagcgggattggggcggcgtgggaacctagagtgggagagattaagctgaagggaggtcttgtggtaaggggtgatattgtggggatgttagaagaaacatctgtcatatagaatgattggttggcctggatacggtcttggatgaagtgacaaactaaatggaataagagaaggagaaaaacaggtataaaaggactaagaattgggaggacctaggacatctaattagagagtgcctaaggagattcagcatagtcctgccagcaaagattatttatttacttcaagagtttagagtggcagtttggggatagcaccaggagatatcagctgcgatggcttggagaaacagtgtaaaccagcagtgtaaacaagagcagggcatgtatgagtagttgagaacggtgaataggagtatgactaacagatgaggatgaaatttgggcttgactgaagtaatgggggctgtctgtgaagccttgcggcagtatagcccaggtaatttgctgagcctaatgggtgtcagggtcagtctaagtgaaggcaagtgttaacaggctttaatcctttcaaagcatgctgtgggatgggatattggcattgagccaggtaagggtgattaggttttaatgagatggtaaggggtgcatgatcggtcgccaaggagggagtagaggtatcttatacttgtgggttaagatgggggaatacaagaggaggacgcaaaagaggctttggattgggaagaagggcatcaatgagatgcggctatggtccaggaatagtcagggaagcagataatttggttaaaatgtctcagcctaataagggaactgggcaggtggggataactaaaaaggagtgcttaaaagagtattgtctaagttggcaccagagttggggagttttaagaggtttagaagcctggccgtcaatacccacaacagttatgggggcaagggaaacaggcccttgaaaagaaggtaatatggagtgggtagcctccgtattgattaagaaggggacagacttaccttccactgtgagagttacccgaagcttggcgtccgtgatggtctagggggcttccgaggcgatcgggcagcgtcagtcttcagccgctaagccaagaagatctgggaagcagtcagagagccttgggccagagttccagggactctgggagtggctgccaggtgagttggacagtccgattgccagtggggtcccgcacagatgggacacggcttaggaggaatcttgggctgcaggcattccttggcctggtggccacatttctggcacttgcagcaaactcctgggggaggaggttctggaggaatgcctggccgctgcggttcaggcgtttggaagttcttgtgtgctggagatgtggctggggtttgtctcacagtggaggcaaggagttgaaacttttttctattattgtacaccttgaaggcaaggttaattaaatcctgttgtgggatttgagggccggaatttaatttttggagttttatttaatgttgggagcagattgggtaataaaatgtatattgagaataagatggccttttgaccttttagggtctagggctgtaaagcatctcagggttgctgccgaacgagccatgaactgggctgggtttttatatttgatgaaaaagagcctaaacgctatctgatttgggataaagaaaaaggagcattaaccttgattatgcctttggctccagccacctttttaagagtaaattgctgggcaggtgggggagggctagtcacggaacgaaactgtaagcccgaccaggtgtgaggaggggaggcgataaaaagattatagggtggaggaacggaggctgaggaagaattgggacctagctcggcctggcgaggaggggagaggtcagatgggtctgtagaaaaggaagattagaaagactcagcgacgcttggggttgggactgaggggacaggcgggagggaaagaaggaagatttgggacgagttgcactgggcgcagagactaggaagggactgatgtgtaaaagaatgcctggatgtcaggcacctcagaccgtttgcctattttacgacaagaattatttagatattgcaggatggaaaaattcaaagtgccattttctggctatttggaactactgtcgagtttgtattggggtcaagcggcattgcagaagaaaataaggcatttaggttttaggtcaggtgaggattgaagaggttttaagttcttaagaatacaggctaagggagaagaaggaggaatggaaggtggaagcttgcccatagtgaaggaggcaagcccagagaaaagagtagagacacggagaaggggtgggggtttcttgccctccagaaaagcagagaaagggttggggcacagaaataagggattggggcgcagagataagaggttggggcatggaaataagcgattggggtgcagagataagaggttggggcgcagagataagaggttggggcatggaaataagcggttgggggttcttgccccctaggaaagcgggactcgccgctaagggtgaaggagaaggggttgaggggtacttgcccctgccccaggaaagcagagaaggggtagagacaaggagagaagaggttgagggctatttgcccctctcccagaaaagcagagaaggggtagagacaaggagagaaggggttgaggtacttgccccttccccagaaaagcgggacttgccgctaagggtgaaggaccaaggcaggcgtccctgcgtggtctgacacccttgaaacatggctgaatgatcagagaggcgtccctgcaatgattaaacaccaagggaaggctgccttcccaatccgtgaccggcgccggagttttgggtctatgaataaaacgtgtctcctttgtctctcccagaaaatgaaaggaattgaaattaagagaagggagagattgaagagtggaaaggagaaagtggttgagggacagtgagagaggttggagaagagagtaagatgaggccgcttaccggatttgaaattggtgagatgttccttgggctggttggtctgaggacctgaggtcgtaggtggatctttctcacagagcaaagagcaggaggatgggggattgatctcccaagggaggtcccctgttccgagtcaaggcaccaaatttcatgcgcgtccgtgtgaagagaccaccaaacagctgaatcactaattgttacgtaaagacaagcaagagaatggacactggggactattgagacatggtatttcattttgtaagaatctattgcgttcctgctgtccttgaggaagggtttactaggcaattaatgtgtcttctctttcctctgcagctcaaatcccctacattccaaggcaacgtctccttcatggcatcaggtacagtcaattttttgtaggggactgaaagcaagagatgtggagaaatatctccctgggtaccaaatggaattactaatgagcatgtatatttagagttattgggccatatgtgagcactgagtaccagatcctaagtgatgtgggtactagatgcttttttaaaatgttgtgtgtgtctatgcatgtgtgtgtatgtgcacttccgtgtgtgcatacacatgtgttgtataaattgaatcatgtctgatattcaggtttctcaaaagggcaagacctagagtagagcataggtcactcttgtctgaatctaaggatggtattaaggaaattcactgcatgcttacattgcttagagaaagacaatggaaagtgtcatgatgatgaaaaaagggctaaatcttaagtatcagtcagtatgacgaagtctctaaaataaattaaacaaacgactggtagttcatctttagctagaatgggcttttcaatgacttttaaatttattacataagtatcaagttttatttattcacttgtctccataaattatttatcattactgtcaatctaaaaaatgtaattaaaattgtgataccctctgtttaaaacacacaaaaacagttccagttagtaaacgaggcattttaaattcaaccaaaggatggcagcataatatcaattacttagagcctgggataaactttgctgttggtaagatatcacaaattaatggtatctagtggtctgataatgtatgatcagcaatacattactcagaccaggtgtattgttcccataacacattagctcactagtctgtctaatccatattaagatacttgctggttagtattgttatattttccttttttgccttgaccactctaatggacatgccttgctttctggccatctactacctcctctccctttctgggggtcggggggtgggggcgtctgtaaacatattctaacttctctgaccactctgggatcttgtgctctggccagactctccagcgtgccacacacagggtgccacatctagccctatcccaagctactcagcgcctccctttgctctggcctcagttattatttcagatatggttatttttcccaatggtatcgacacagctctactccattttctgagcataaactttcaaatatttgaccatattaatttatctatcatagaattctggagctggaattgatcttaaattgatatctaatctctgcttccctttccctttttgaaaaattcagtcctaaagacaatagatggacaaaacaatgtaagcattttgctggaaagggcaggaagccacactgctggagctcagacaggcaaaggtgactgtttatgtggagagagaacctggcatgggtgtcacagcctaagagtgattagagcatccgtggagcggggctgctgtggggagtcataacttgagtggagtgaggagaaatattctgtaaaacaattgccctgtaatcgttcaaggtcatgaaaatcaacaaagacccagcaactgctccagactataagagactaaagaatatagcaactgaatgcatagcatgattctgaacaggatccatttgctactaggaatattatagggtccaagcaccgtggctcacacctgtaatcccagcacttttggaggctgaggcgggtgtatcacctgaggtcaggagtttgaaaccagcctggccaacatggtgtaaccccatctctaccaaaaatacaaaaattagctgggtgtggtgacgggtgcctgtaatcccagctacttgggaggctgaggcaggagaatagcttgaacctgagaggtggagagtgccgtaaactgagattatgccactgcactccagcctgggtgacagaacaagactccatttcaaaaaaaaaaaagaatattattggattattgggactacaaatctaaatacgaacactgagtatcatatggtgctaacgtaacaatgttaatttctgaattttgttgtggttatgcagggaaaatatctctgttggtaggaaacacacattaaagtatttgacagtattggtgcatcagcttggcaacttaaattatttcaaaaataagattctctctcctgtattttcaactttcatgattatttcaaaggataaaaagtgtgtttgtattttttaactaaataatccacatttgagacatgatgacagaggtctaacagagcagaatagccttctttttgtacactatcatcaactatactgttctccctttccctcttcataatttaggccaagaatggcaaaagcacagtagaaaggaaaagaccaccacttctcatgaaaattgtataacatgatactcagcacatgggctttaatgtgcaacagaataggtttaaaccccaactctactacttgcttgctgtgtggtttttagcaagctattaacttctctgtgtctcagtttcatcaatgttaagacaagtataataatggtgtctcttggagttgttgtgaaatctaattgagataatccacctaatatgtttagtatagtgcatggcatgtaagccatgcataataaatgttattatttatgttattattaaaatatcatttatgctaaaatgatattattaatagataacggcagtctgttccatcaagctctaggtaagtactttcaaaatgctctgagggtagcccctattaatcagtcacagctggaaataagatgaagcccattttctattaactgctttttcaacaaatgtcaattaattcaaagaaagaagaaccaagtgtgtacatactctagaagcacttagatgacatgtattggtcctcatgttattaattcattcaagaaatgtttattgattgcttattatggtcctagcattgctccaggccctgttcagttaaacagagataaagatccctggaatggagtttgattggattaggtagggtaaaaggggagaaatagtagagtataagcaaatgacatagcacagcagtccccaacctttttggcaccaggaacctgttttgtggaagataattttttccatagaccagggtgggggaatggtttcgggatgattcaagcacatcacatttattgtgcactttatttctattactattatattgtaatgtatactaaaaataattatacaactcaccataatgtagaaccagtgggagccctgagcttgctttcctgcaactatctttctcatttggagggaaactatatttcccatctggaggtgatgggagacagtgacagatcatcaggcactagattctcacagggagcacgcaacctagatccctcctatgcctagttcacaacagggttcgcactcctatgagagaatctagtgctgccactgatctgacaggaggcagagctcaagaggtaatgtgagcagtggggagttgctgtaaatacagatgaagctttgcgcactcacccgctgctcacctcctgctgtgtggccctggttcctaacaggcaatggagcagtaccggactgtggcctggggattggtgacccctgttatagcattctataatgcagatgtataccagagtaaaatcaattacgagcatctctttttttctaaagttattgaccttctgtatacagaatgacacaaacaaattgctcaagatcaatccccaagaaacaccaatatttaagcaatgagtagaagaggagaccaaaaagtgaaataaacaatgtctaggccaggtgcagtggctcacacctgtaattccagcactttaggaggctgaggcgggtggatcacctgaggtcaggagttcgagaccagcctggccaacatggtgaaaccctgtctctactgaaaatacaaaaattagccaggcatggtggtgggtgcctgtaatcccagctactcaggaggctgaggcaagagaatcgcatgaactcaggaggcaaaggttgcagtgagccgagattgcgctatcgcactgcagcctgggggacaagagcaagacttcgtctcaaaaaaaaagagtgtctagatcagaaggaaaaccagttttcaagaacaaaggattgtgtaacagtgtcacacaccactaagtgggcaagaaaagtaagtacttgaaaacatatgttgaagttaattacatggacattatcagtgactttggcaaacggaattttcaatggagtattagggtggaagccagatttcaattcttataagaggaaatggaaataaacaacaaaatgatataggatatgcccacaaaaatttgatcactacatcgaagagaaaaattaactgaaaataggagtgagaggttcagtcttggcaagttttgttttttatcttgttttgttttttaaagtgagaaatattctctgttgattagaagaaaccagtagagtagggaagaaatggaaccagagcctcatgttgggcttggtctgtaacaggaaggagaaaagaataggatcaacacaggtttgagtgcaggtttagaagaggaagctcagtgtttcattctggtggtttctatttgttttcttgaagtggaagactagagcacgtgatggaccatctatgagattaacatgtgccctggcacattctattttctttgctttgaaacctgtcttgtctcccaattcaactcctcttcacccagctgacatgctcttacacatgggcttatagctccattcatagctatcattatagtctataagatttgtgaccatttgactaatttctctctctcccttcagagggtcctatccgtttctgtattttgcttacagtgcagccacacagtgtagcacactacattccagcccaaaatacagtagacacccaataaatatcccataaatattgaatgaataaatgaacttattcaatagaggagaaagaggtgttctaaacttgaagggagggggcaaattttagggttgtgatagaaagaatgtgagggagagttgacaaagacaggagagcaatattgagtatctgcttacatagattggtgaactaaattaatagaggcaccaatttgtcttgatttaaataagcagagaagattcacagtccatccaaggttgggactttggcaggtgagagtcaactgaatgacaatgaaacaagggattctaggatattggtaagagagctgtagaagtattagaccccatgatctacaacacataagtttgaattgtacatagattatcaaattcaggggcaacgtagttctccccaaaccctctgctcatgtttaagtcttaatattagtctttagtcttaacactttacgtacaatgtaatatttaatacacaagtcacactgttagatgtacagtgtcacttgtatgtccactcaaatggtgatatcgaaataacagccattacttactgagtatatattatgtataagacacttcttgaagagctttatgtatttggtcctcatcatctaattcttttctttccctcttaatcctcagcaggattctccggtaaaatatagtaaagaaacagagactcttagcataacaacacgtcaaagttacaagaagtggcctagttatcaagagaaaaatttatcctacagatgctccattgtgacaaaatttaaaaacctaagctttttaaaggtaaatgttaaaaggtacatgaacactctaaaaaagatgtaggcaagtatgaccatcatgattctgagaatgtttcatcatgtgtccaagagtgaaccaaaaacatgaacagaaaagggaggagagattaagacagagggaaaatggagtgggggagatgagagatatgaaaccctggacaaccatctgagatggatctctgtggactgaaaaacatctcattaaaagaagttaagagatagtttgaatgttctctaactctaggtgtgttcactgttgattaaccatgagattgttttatttctgggagtagacaacacacccttggctgtccaaaattattttattgacacttaatactcttactatgtgctaggcatttgtctaaaggaatcacaaatattattaataatttatttaatccacaaaactaccttatgaagtactattattatccccattgcacaaataaggaaactgagctactgacatattaaatccaaatgttgtgtgcattattgagagaataaatataatgttatttctaatctttataatattcttgagaggcaggtcttatgataataagatcattttaaaaatgaaaataaaagaaacctatgatttagaaaagttaacatttccaaacatggtcagctgggatttctacttctggtcatgagggactgacagggtcaagaattaccctccctctacaaacaatttaaaaactaaacaaaatataggaaacaactattttcagtcattgaagaatagccaatccaggactgtgatccctgagagatgggaaacaaatgaggctttttgcctgggggcaatttttagactgtgttgcagggaggaggaccctttctgagcaatctctctcagttcaggagacagagataaaagtctgaggaagccaaagcatatgaaatttgcaagacagagtacccaaaagaagtgagctacccagaaaaagagttctagaatttttttataagggtccccttgagtctttggtaaatgctaatgtgtacatgcactgggtaaagccctatgaggcccagcaagtacaacctccaaagaaagaataattgctggggagctttaagccaaacaacttaagcgcacattcaagactgaaaattgttcaagttcccaccagccacagggcaaaagaccctaaaagggctaaaacttaaatgtggggctaaattagcccgaaagtaaagactactacagatctgtcttaaaagaacataaaaacaagactttaatcaaactaatccacaattaccatagctgcctactgaaacaaaatccaacctgtttaaaggaatacaacaaaatccgtcacacaaaaacatacaatcacaataactggcattcaattaaaaaaaactaccagacacaggaaataagaatatataaactataatcaggagaaaaattaatagaaaataaatgagatgatagaattagcaaaaatattaaactgctatcataaataggctccatgtattcaaagatatacaagaaattaagtataaaaataaatgaaatcttgaaacaaatgttcaagatataaaatacaatatctgtaaaggtcattagatagccaaatacaacaaacaaagacaattgatagtaaataaaattaaaagtcagctccatgtgactgtaaggtattatcgttttccatggtgcattccattgtatggtgctctgtaaaaagccacagctaacaacaaaagcatgcatgtcaccccaaacagagggaccatgagtagagggacaaatggccatgacacaaggaaaagaacagttttagaatcaaaatagacagaggctcaaattctagctctgtaacttatcaactaggtaaacctacatgagtcttcggaaactgagtttattccttcatctgttaaatcaacatagaaaggcctacttcatacaaagcaataattgatactacaggtaagaaagtattaccatgttgcttgacacataggcacataaatcttttttccatagctgatagagaaaaaccctaaaattctcatgtatattcaagaaactaaagaaatattgctgattagaaggcctgacccaggctcaggaaaagttatggtgtggtgtgatgtggtgtgtgtgtgtctgagtgtgtgtgtgtgtgcatgtgtgtgtgtgtgtgtgtgtgtagggggttggtcctgggtgggtcagatgatatcaatgaacatatttttctctgaatagcatgcaaagtcttaatgaatactgctcttctgacctaaaaaaggtaacaggcattctaggtggaaatcatcacagaaaaggatctaccaatataatttaggaaatatagcaagtcaactttaccttggaattaatgctctgtttttctcttggaagaaacaacatactggatgtgtcagtgttttacactaagataatagtggctctgaaatctagcctaccaaatgtacagtgcttgggaagagagttaactttttagtaaggctccatttctgtaaaagaggaatgctgatgattaacttgcagagtaattataaggactaaagaagataacatgtataaattgcctagtaaagacattagtaatttaatatttatttattctctgaccctttgaagtcctgccccagccccccaattcatatttattttatctcttggtaccaagaaatcctccttttgtgggaactgaactaagattccattccactggccctctgatgtcaacttcttcagtttagacttgtcacttcttcctttcctgaagaaatatttgaaagattaaaagagacaaacaccagcgaagtcattgtaacctcacagggtttttgtcacatttggaattcattaatctgagttttgagaagaactcagttgacttcactccttggtagagcaaagagaaaaataaacgagaagacgatataatattaaagaactggaacctttgccctttgccttcttaatctggcctacatttctcaaggctctaagcaattaccaaatgacggagttgtctaaaatcaattctgcttactttgtgtaactaccaaaaatcagatatgaagactggtgcctgacctggtccagagattaatgagtttgctgagcaacgaagtctaactacctggttacacatttttcttggcacagtcaacagccaggaccaaaaggatgtgtgaaggctacggtctaaaatggttacaggaaatactgagattggtgcaagtggtatcaaaagaccagatgggaggctatccaaatgacctatagaatgctatgccagaaacccaagttcatctgaatgccaggtaaaaatacgcttgtgggctaacataagaattgccatctcaaacaaggtactttctaaataaatcagctaaaactaagacaagatattgctgcttaaaaaaatcttaattaaaagtgtaatattagatctgtaaagctcattataaagactaaaactggtgtgcctggggtacaaagagggaagagtgttagacagatgtacttagatacaatttcaattttttctgggcttaattacacttaaatattgggccaattaatcttcctgattaacttcctgagggcaccctagcttgaccccatctctcggtgtcaaacttcactttgactaacctaggaagctgggaaacccaatctgagccacctttggtcacgtataaatgcaaaatgaaagaggtcattctaaagtcgtgaaactgagagactgctgctcagagtggcttctcttgaaattcaagagaagatggcttggaagtggtaacacacacccaacaacaggtagcaattggggcacaggtgaagaaggctggaaagatgtcagtgtctttgataagcatcctgtgtggtgacagttcaacagttctcctgtttggggcaggaataaaggttcttaaaaacatcttaacacacagaaacaaatgtcctctttgtcactgagtctgtgctgtagatacagtcaggtcatataatgaaactattcatttgccttgggaatatgaactgagcttcttcctactcatctcatccattctgaaggtcaggacaagattaagatctccctgaaatgaatcaactcctggctagaggtgcaccgataattttcaaaatggtttaattacttcagtttctgaggccctcagagttgtttttttctttctgaaccatcaacatacatatttatgtaccaaacagaaaaaagcattaaaaaaaacaaattctattatggaaggcagaaaacagacactatgaaatagttgccagacagctattatttaggattgagtgcctagataccaagtattgtggtacttcaagactttgaggttgcatcacatggacttttaaaagggtgtaattttgaatcataactccgcattattttggctttcacatcaccatcccagacagtaaaaaaacagtgattattttcttaaatataagactgaacactatagtgtttaagtttagattagtaaaattgaacttttccacttctaattaatgtctatttctcattaacatatctggttataactagaaagttacatactgatggtgaaaggaaaatgtacatatgtgcatggtacaggataagtgtggtaggaagccaagggcattaaaagagaggcaataggtacagagcattttataatttgttgagatataaatacagacacaagcactttcttaaaataaaaaagcagtgatacattttctgaaagtctaaaaaattttacattagactttacaatagattaatttgtcattttgtttaattatcaggaggtaaatcactaagatcattggttctcagatttaatggaacaaatattttgcaagttgaagctaggtgctttactgctaaaattaaataaaagcaggcattttccaattcatacacaagttaatggatacagctttctaaattataagcatttttttctcataaatttgtcttaagccattagtgcaggcaattgtttatcttgtcttctcaaggtggtatctgatttgcctataatatacaattaaggttgtcatagcaatacttcatcgtgttctgttaaaagcaccatgactcctagatgttctttcccttaaagaagttacaagacaatagactaatactattgatctattggcagatgggtaatttcaagctgtgaaataaagagaaagaccaggcatgcttcccctgggcctcaaacagaaatgaggacactggatgtggtccgtggaaatgtagggcattgcatgcaaggcaatgtggatgtcgttggctgtcttttcaaaggatgacgttctagtgagtgatacacaattaacttcgagacttttcgggaagtcagtgctgtcattagttgtgccttatgtgtctccaaaaagaaacttgatttttacctacttgctttgcctttgaaacctagattgtaagggtttgaaatgatcataaattctattcacttaataaaaattctgtcagtcattttaacaaatatttactgagtgcctaccaatgatagcactgaaacctagatattccacatttgattccttagagattggttttaatgtttcattatatcgtttttcttggctttcctgagaagaacaagaagttgctagtttttagactcaactgtaattttgccatgtcctaacagctgcagaaaaaaacacacataccaaaacatattaacaaagaattacaaatattagctaaaggcaagagaaatgccatggaagactttgcattatcagcatgctgcttgattactacttttaaaaacagtccattaatgtttaaaaaattaaagaagactaggataaaggaatgctaaactgattctgggtacagccataaaaggctgttttcaggagcacatgaagacaagcaaaagatgagattaaattagaaatgggatattcatgctataggtataaaatgatttactgagatatttggtattacataacttaggaatgaaatcaaagttgaaaaatcttggaaatttcacagactattagactggatgactttaatctagagaaatcctttttattttcatggcttctctaacttcttcactcagcaaatcactgaacataaaatccatttgtggtgtgtcaaaagaacttgacctaaagttgagcgcaaagtgaagagactcagcctcacatcttctccagagttcatctaaaattattggaagcaataaaataagagatagtaaaagagagggcaaacacgaaatgttgggaatttacatgggctctatttagaaaaggtgaggaagaataaagaaaaagaatctttaaaatttaagactttttcgaatgttagcaatcctaaatcttgttaagtgtgtggcttgaaggacaaggcacattatgaaaaagagagaatcaataattggggtcataattttttaaatcaatacaactattttagtgtttgtggaagttctgttaagatatgagagtaggaaaataattcaaattttttaagtgtacttagatatataaatacttctatccagtgatggcatttggtgagtgtaggcagaaaaggctcacatcccttatgaagaggaactaccccattcataattcctatgactgagccagccacgttgtgtagcaggctggaggtggttggaccagaggtggtatatatgaccaaagggctgcctatgcgagaaacctataatgaggactggtccaaaaggagaactgggcccatcagtttctctcttgggaactgtaactgggacaggtaaagactgctacaattaacggtgggaggtgaagctgaaaggtcatgaagtagagacagatgatggtacccatacaattctctctaagacaagtctatggtaagagaaaaacgagtaaaaaaaagataaagtgaaaaagactctcagaggggagcagggaagcattgagcatagtcataaagaaaatgacaggtgaggaaaagagcatacccttaaagctgctttggttcctgacatcatctggtcccaggccttacaaattcttacactggaccccttctcctcaaggtagccagggcaagcatctgatccataaaatagagctaaccagaatagcttatataataaagcactgctggaaagcctgagcagagaaatatgtcctcatttattgaaagcaactgcagcattgtgtgtgtgtgtgtgcgtgtgtgtctgtgtgtgtgtgtgtttacaccttaaaagctgactccttggaagtactttgtatatgaaacagaacaaatgataattgctatgacagatattcaacaaatgtgttatatgtgcaaggttttgtactagatactgtgaagataaaaatatacagagaagacatgcactctatcttcaaacaatacttagaggaggatctcttttttctccctcacaaccacgaataagctgaagaataaattctgccctttaaacacggcaggtgcacaatgatgttttacagaaacaaatgctttatatgattgaatcacatacaatgcttttgggacacataggaaaaaaacaattttatttaagaggatcagggaagatttcatcaaagaaatgtaatcttcactgggcattatgggatgggcagttcttcagtaaaaagagaaacatggaaaaatacacaaaatggcatgacgatgtaaatgtgtgttagatttttagaacagtctgctttggttagggcacaggtacctgggagatgcaagaggaaaaatggtttggtgcaaatttgtggagcacattaattataaggctaaggagttatgactttattaagtaaaaaagcaagacactaagatcatcaaatgtatgttttaggaggataactctagcagacatggaaaacaggttcagattgggagaaaggcaggaaatagaggctgggagatgaattagaagattttaagctggctgcttgtgagctgggtatgaacaaaggcaatggcagcagtaatgggaagcagtgactacctgagagacactgcagagatgtagtcaacaggatttgacacatgattagatggggggaggaggtgtgagagtaggtgagaaaaaaaatgaaaggtaacattcaggttcccaatgtgaatgcttggcaaagcttttaaccaagataagacaagaagccatttagattgcagtaggattctggttttctaaggattgagtttgtggtacaaatggcacagccatttggggggatttaaaaagcagctagaaaatgcaaaactgcagtaaagcagagaagtctggactaaaaatgttaggtagcacatcttcagtgtgtgtaagagctgaaaaccaaatggtagatacagatgccctaggaagaaagagaaatcaagatttaaaagattggaaaactattgaaaatctgctttaagaggaagggtgaattcagtgactagtcagagagaagactgagaagacagttgttagaaatgtgatgaataagagtagtgccatgaacatcaaaaagggagccttgagggaactaatggtcaacaatgcgagtgactactgggttcgctgatgattcagtcatgaacacctcacctttggaagcagcagttccaatctaattatgagaacagaggatagattgtaacgggtcatgaagaaacagatgcaataaatattagctctttttgctagaagttagggcacaaagagaatatgatggatgggccagtaacaaagaggagtgacagcatccagggaagtttaatttttagatacacgagagggcagaagtgaataaacctgtggagagaatgtgaatatccaagaaaaaagttttgtttcatgagacagtgacattaaatccttcaatggcccctcatctaacttatgatattacttgtacttttcataaggcttaggagacctgtgttgggccccgtccgtgtattgcgcaccccatttcctcttttcaccgctattctcaacactccagacatgtcagttgttgatgtgccaagatttctagcttcacagctctcacatatgctgtctgggatactcttcccctgccccgcgaccccccctttttttttttttttttttttgcctgaacttaaataatatttcttccttaaagtggttttcctttaccacttcctgtctaaattaggtgtctttgttatgtttccatacacaaacaagaaagtccttcgccataataatcaaacttgcaatggttatcttttttcttagactgcaagtcatagaaaggtacggactatgtatggtacatgggaggtgctgaataaatactgaatgatgaataaataactgaaaaaatctaggtcatggcacaggaagtcaggaaaaggctttctgtgcttctaataaaactgctagaacttttatattcaattcaggtaatgatgcagagaagagttatctaattcaaaataattataagcaccatgtaataactttgaatgtgttacatttagggaaatatgcatctatagactctaatatttcaattttaatatatgggctttctcttattattggatttgtgaccttaccgccaattatatttgcttcctttgttttttttacctctttttcattctcaagtaccgattgttttttcaagtacactagacctggatctccttcccaagataacctctgtctctccaagatcctgcaatagctcaacacaattttttatgacaagtctccaaagtccaatatttgagtttcttatacacgttttacaaatcaggaaaggtttgcaagaagaaaggcaggtgagaaaacacaggcagggatcattctgggtcacacaaattccatgaatgctcttctataaaaactttcaatggccaagtaattaacttggaatcagcaagtcaaatcactcatttttttgcaaagttcagcaattagatagaacatatttccaaagaatgcaaaccacgaaggtggcttgcttccaagtaactacatcattttcctgtaatgccatcccagttggtttcctcatgcatgcttgatgattctcctcactatgcatctttttggacttccagattttgactcctaaacttatcaaattaactttattgacagaaagggtttctgcttttgttggatacatgtagattatgtgcctgctcagacagtgtaaactgccactctttggtaatcttatcttcaaataaggacacacacctgccctgatacttactcaaatacttactcagattgactaatgaacttataatgaactttcttatcatttaccaactgggctttgctctcaaggacataaaaactatgatctttacatctgggacatatcagtaattcttaacagtaaaaatatatgaccatgtatgcagttcatgggcaaagtccattaacactcacttaaaactaatattttcttcatccaagagtaataactaaacatacttcttaaactgaaccatgcattcaagaaaccttaggtaacatctaacgtgttatctataaagtctcccccagctacgcgacaggaggatcttgcttacccacattccaattagatttcccaaagtttggctacttgagcagcactttcacaatttttgtcatattccttgactataaatgccttaacattttatttaaattaattttaaaaatattaaaacaaatttacttttaaaaggagatgctgtgtatttttctaatgtatattaatatacaaaacattatatagaaataagaacatcatgtaggtttcagtgaaaactaaaagtactttggttttaatgctttggttttgtttgttttacaagacagggtcttgctatgttactcaggctggccttaattcctgggatgcagccatcctcccacctcagcctcccaagtagctgggattataggtgcatgccactgttcctcgctttaatatggttttgagacaagtattgattcagtaggaaatccattctagtggatccagccagtctgccctacctttctgcttctgcattcctagatgagatacctgaaaggggatggactcaacaacacaaatctcctatcagtctagctgctacaaatacaatggtaaacgattaaaatcctacaaattaaaacagtatagccaggcttagaataaaatattttaattttttaaaaattttaatcatttcaaaagcaaacttttgtaggagtgaaaggaaaaacggagggttgaaaagaatttataagccatatcttagaacttttatttgtacagcttcttaccattctcaaagcagttttatataccttacctgatttgagtctcataataagccaataacataaaaagcaagtatatgagtcatagaataattatcattttatttctaggcttttagatagagtaagagaagcaggacctttcctcaagataaaactaaaataccacgtttcttctgtttttgactggaattatttagcaaataagtgcttcaggttggatgagaacaaaggttatctgccttctatccagaactctgctttttttctcacatttaagttagacaaaaacaacataaaacaataaaacactgaaataaatttaaatacaattactaaaaaaacccaactttttttataaattgtcttccaatttgcttacatagttttcacagctgtattttgcttttccctcttttctaatacaccatataatctcttctactattacccccaatttacaaataagaaaacagattaaacgatctgccccaactcatgtacatggttacaaaatggcagaaatgggactaggacccagatctttgtgcatttcattctgacactcctactactacactacactacctcataaaggaaaagacatctcaaattttttaaaatctgcaaaaataagaaatagctcaagatatgatcctttagtttacagaaagacttatcacagtaagagtcctaaaaatcttgaaaattccttctgcataattcgacctagtctgtagccgaaaagagctcatatatcatttacaatttgacaaaaatcctagagaaagaatatttagaggtaaaggatttgggtcagtatcaaggcaatcagaaaagaaaagaaaacatcttgaaaattataatatgagccaatggagaaaaaaagcattgaagttaaaaactctgtggaagcgtatcaccatcaccccatacatggtgcagtgagtgctcctgtgaatagttataaggctgtttatgtaaggctcagtgtaagaaggacaattacaaagcctttttccagtttttcataagcacagatacagtcggaaagcaggctgcatttaagaccacgaccaagttctatactgggaattgtataagacttaggacagtatatatatacacacacacacatatatatattctagagaatatgtatacatatatatatacatattcttgagatggagtctcgctctgtcacccacgctagagtacagtggcgtgatctcagctcaccgcaacctccacctcactggctcaagcaattctcctgcctcagcctcccaagtagctgggattacaggcgcgtgccattgcacctggctaatttttctatttttagtagagacggggtttcactgtgttggcctggctggtctcgaactcctgacctcaggtgatccacctgcctcagcctcccaaagtgctgggattacaggcgtgagccaccacacccggcctcaaagcacagttgtcaagctggatcagaatcaataggaggatgcttattaaaaatgaagatttgaagtctcagtcaagatgcattaaatagaatgtctagggaatggtttgggaatctgcatttttaaacaagctctctaggtgataatacaacaatgaagtttaaaaaccactgacttcaagaagttattggacacttcagaatattaattattattttagtctcttacactgatgttcctaaatctgaagttttaggggtttgggtttctccccacaaacattgttcacttcgaatcaaaaaagaagcttcaggtgtttagtaattagagtaaaacacgtttcagctatggaggatggcgcttggcaagcaatgttcatttccacacatggaacccagctcatcaactacattgaggtcaagggggcactggatatgtctgtaactgatgtagatgagggtacatggaactctgcaaaaggcaaaagaagcccaaataaactgatgaaacaagtttttaaaactaagttataggtaaaataaataaaccagttcttgtaataaactgtatgtcctggccaattgaccctgcaacaaattaccattaatataacgaatggataaggcactgtgaatctaattttcagctaaagctgttttgtgagttcttaaaagccttcataggcaagatcagcttgtacaatgatgtctttaaacaaattatccttatataaagagatgcttataaaagttgtagactaaaactacctcacttttgtgctacacatttttgttaaattagcagcttagtttaatatactccaagaggcatgaaatgaaggtataatgtgatctttctgtatgttttaataccctgagtaataataaataatgacaatcgagaatagtgactgctactttatttcttggaaaagcattaaaattaacatgaaattttatttattaaaagcaaagctttttattaaaacttcaatgcttaaaaacatgaaacatcaaacagtatttattaaacattagtatttattaaacattaaaatacaattgtatttactgaacattcttactctttaaagtgaatgtgtaaaaaccacttttaaaagagatctacagataatgagtaactccagaaacaaaggaagatgaggaatgtgaactaaccaggagaagaacttgagatccttgacaattaactccttggtctctcaagatttctatctttacaaagaattctacatgtactatcgttctggcatagaatttccacacatttcacataaaatcccttgtctctaactaaagaaaacttttttcttagtagtgaaataaatgtgttgagtgtctactggtatgcatatatcaagaattttagagacactaaatttttagacatgtgataagaatcatctgactaaaataccttatttccttatcttgagggtcctatggagtcactattattactctaattttacatttgtgtaaactgtggctcagaggttaaatgacttaagaacgcaccagtaatgagatttgaccataagttttactttgaagctcatgcttttcccaataaaatatgctgacttccacaagtctatggatccaatgacacatttactgtgactgctttaaagagttaggtttgcaggcccagaactcaacattatctgtttatttctttattattagttttgtgccagggatttcaccaaagacatttataatgcaaaaactataattatttgatatctcttttgcatcagggtagagtttcaaaaatatgtattgagaacctactatgtgtcacactctaaggatacagtggttatccctaacaaggtccctaaccctcaagaagcttacatggtagtgcgggagaaaagacactaagcaagtaaacaaatacgtttcagggagcaccaatgtttctgaaaaagcagagtaatgggataaagggtgactgaagtgctggagtattttagatagcatggtcacagaaggcttctctgaggagatgatatcctcgctgaggcccaaatgatgagagaaaggtaggcaagctaagaggcaagaacatcctaggtgtgtccaaggaatagccatacaggccaatgtggctagcatggagtgaattcatggtaggacacaatacatagcaggacaggaagtaaggaaggtgagaaaggccatgtcatggaaatccacatccaaggaagggcgcacatacacagcaatacacgaaggactggcatgcaggtggccatggctgctgtcagacaggaaagatggcaatatgttggcatagcaggttcccagttcaacagctatgccagcatcttgcctcctctccagttccaagttacaggagaatactatgactcttcagtgttttacttttccaaaatttttcctttcacctgagggagggaaaacacactcattaattgaaagcgcacttatttctgatcataacaacatagtcttccttagagtgtccgcttttgaagatgtagttaggcacaggaggtttgtgggtagttccatttttttaatggtctttgatctaaaatgaacctcgagaatgtttatggactacttgtgaaaccacagggatgaaattgtgacaaaaattttattaaatcaataatgtctaaagttgatgacagttaattataggctattaccaccatatttatagtccacaaaatatcccagtgactctcagtacaattttatttttactctaataactttacttggtcaatttctgccactcagatgtatttaaacaataacaaactgtggctcagcagtgtgtagttagttcactgctttatgtgctcttaaaaataatgttatttttggatttttttaaagacattcttgctctgtcatccaggatacagtgcagtggtgcgaccatagctcactgcagcctcaatctcccaggctcaggtgaatcctcccaccctagcctctcaagcaactgggactacaggtgtgtgccatcactctttttttttttttttgtatttttagtagagacaaggtctcgctatgttgcccaggctggtctcaaacccttaaactcaagccatactcctgcctccacttcccaaagtgtttggattacaggcatgagccaccatgccctgccaaaaataatgctcttttgagccaaaaattcccagctagaaacttatttcacaagtacatttgcaaaagtaccactaagttctaggtccaaggatgttcactgcaacactgtttttaatagtaaaagattggagacaacttgaacactcatcagtatgattgatacaggctaaataaataatatagttatacaacagaatatttggtggtccttacaaaacagtaaggcataagaataatgacattatgtataacttttgtgcaagtgaaaatgtatacacagacacatacctggagggcatacatacatgttttttattaaaggataaatgagcaatttattattttaaataaaaaaattggataggattataaattatgtttgctttcctctttaatatgtctctattaaaaaactagtaagtaatacgtattatttacccaaaatggagtgtaaggtaacctataaaggtaaaacattttgttatatagtgctaccaaggtatagataaggaagaagcatactcttttaaatatgattctagtatcaattgcctttgccagaaacaaaagtccagcattacctaagcctggtactagatatacacatatgcagtcacccacgcatatacagtatgtggtgtctgttcttgtgagggtaggaacttatgagtgttctattgcacaaaagcctgtaacatcttgtcctgaggctaggtaacttgtggaagaggtactaattgacttcctaggatacaattcaacttaattgcatgatctattaatgtaagggtatttaggaatttggggatcattaagtacagagcattgaatcaaaattaatggcaaatgcaaaacaggttaggtaacaaaattctgaattgagaagatttaactgaataaagcttctccaataaactcattattttaaaaaatattactaatatctgatattcataattaagaggcaggtacaagctgcatcattttagaaggtatatggtacatatttgaaaacagtaatttcttgtgacttttttcagttccattttgcacataaaaatttcagattcaaggccaggcatggtcttgagtacatctcagaacttttgaaggccaaggtggaaggatcacttgaggccaggagatcaagatcagccagagaaatatagcaagattccatctctactaaaaataaaaataaattagccagctgtggtggcatgcacctgtagtcctagctacttgggagaatgagacatgaggattgcttgagcacaggagtttgaggctgtagtactgtactccagcatggatgacagagcgaggtttttctcaaaaaaaaattcagattcattttgtaaagaaaattgaataacagcaactatctgatttaccagtcagatgtagcagatacctgaatatttaaaaggaggaagaaaacttactttttaggttatcaaataatttctcaatgtgtaattgaaaagtctagaaaaaaactgtactcttttgaagaagctgttgctgttgaaactgaggtgctttctttaatttctctaatatatcctgagaatcatggctttcaccaggttactggtaaaacccacaccctcaccacatataccttaaacaaatttcttgcaaaactctaacctaaccaggaattgttacaatgggaaaacaaatcaggtatatatatatatacctgattataggccttagcagttaaggttaaaccttgaaaaatgctgacaaaaaaatgccctggagagaatgcagggcccatttataatttttttcctaaaagaaaaaattttcttttacatttcaaacttttagtattgtaactaacaaaataaagttcaaagtctaggattcttcaaattattctaactttaaattcatttaaaattaataaggtgactttacttctaaataactgatataaaagtattctggcagcaaatctagcatgttccagacatatgaagggcaagggggaattagctataccaaccccaattaatacacagacataaagaataagaactcaatcacagtaactgaaaaaaatggagtaactaacactcactgtggcttttcagagctgaaatacaatctacttaacgcctcatttttaaaaaagtgttttctaaaaaggggttggggtaggggttgattatgtataaaaagttagaatgtcctatttttcatgtacagtattatgaaaaactttgtggtccaatcaagaatataactgtaggaaaaaataacattcactgaatgtgttggtattgcctttgggaatagacaatttaataggatgtgctcaaagctactccctaaattgatagaagccatatgtgtctctgccctacatctgtggggagtggtttgcaggaagaaaggagtacaattatatatacatatattcaaaataaataaatacatatatatatattcaaatgaatgaataaatataatctcttataaattggcaaagacaacattatggcccctggaaggactcaaaacctatggagggttccatgtattaatgccattcattgtacacttgatcactatccatatcgcacaaaaaagtaccaatgagggaaaaaacaattacaatagaaaatattttatttatttgtgcttaaacagtcatctatagtattattgaggagaaatactgaaataattacagatacttttagagtaaaaaaaggcagcttataggaatggctaagaaaagaatttataaaatcaaagatttttgaagtgtctttacattagcaagcctgtatatgtatacatgtgtgtgtatacacatatatagcatacgtaattttaatttttatataatcttttttatggaagaacaccaccaaagacagaatataactcttttaaatttaggaatactaataaaatacaactgaatatctctatcaggtatcagaaacgatccccagggcaactacaaagtatagaaaaactgacaaaaaggagttaggtttttattctctgccccaccagccctgtcttgcctgctggaagacctcacactctcttccctctgcctatccaacttcccacaccccccaatatacagacacaccacagtacctacaccaggcttgtcctcccacaaaatgccctatttcccaaaattccactccactacccttctaaattcccatttcctcttcacatatgttgtctataggaatgaggaagaggaaatctacccctacattataaggattcaagacaaactgcaaattgttaataagcttaagcatccaaaaggatcccaatttttaggagacaagtattatactaaactagcaattagtagaaaatatggaagatattttgaattcagagctctctattctataaccccttgcttaaaatgggccaaaattaaagcatttcctattttccaaaattcataaaaacccactgaaaagggaaggtgggggatgaggggagaagtaactatcttttttgagtaagcagtatatacttttacatttttcccatacttaatcctcagaaaactggcagtggtagatattattatcgcctatttataattgactaagctgaggctgaaaaagtttatctagagtaaacatctcaaagtcatcaacctactaataattccattaatttaacatttgttggtcttctattatatgccaggcatcgtgctgaagacagggcctttacctataatgggtttccaagtgggaggtgacagtatatattttcacataatttggtaaatcctatcatcaaattatacactagctataataagaacaaatacagcatcatgatggattacaatgatggctgaattctccctgaatccaaatcgtggccatgtgactttgcagtacatattctgactctggagttagctgtataatttgtcttggtcagcttgtgatgtgagcaagacatgatgcaaacagagcttaaaaagcactggtgagactaggcctgcctgctctcttgatcctttgtcatcatgagcgtatacccagactactctactaaagaataaggcgcaaagaacatggccaagtctccctagttatccccccagccaaggcccatctagatcagccaaaagcaagccaaccccaacatgtgagcaaagccaaccaaaattaatagagctgcttaggtgacccaccccagatgtgtaagcagtaaacactgctgaacttatttgaggatttttagttgtttgctatgcagtattattgtagaaaataactgatataagtataatgattaaaaccacatgctttggatttaggctaaccaggtcaaaattgtcattagaacagcaaataggccatgtgaattcaagtcacccatttcatcacatgcacaacaacaaagtcaccaactccttattctgcactgtgctggtaaatgataggatttcaatgaacatttatggataaatgagtaaacattgattaactgttttgctagactataggttccttaagagtaggaggaaagccttacttatctctgtgcacccagcatacactgtgatgaaagagacttatagagagatcagtcagtactggttacatgagaaagtactatgaatttggattaccttattaagatggatgggaaaccactaaagggctgtaaggaagccaaacaacaagatttgtgtttgacaagattactttggctgctctataggggtaaacggacaggaggggccagaacggatgcacagaaaccatctaggagccaccaaggctgtctgtgcagagatggtgtaaccttggattagaaaaagaaagcacacagattcaagatatatttggaaagcagaagagaaaaatttgcttgaggcttgagggcctaagaaaatggaagaaccaagaaaaaaaacagttttctgctctatgctcctacatgagcagtggtgactttcactgatagggagctcaaaaacacaacagatactttaaaaatgcagactcagagagactctgagttaatcctagtctaaggccaccactgggaacatctattcaaagaatctgtgacatcaatttatgtgaagaatgatattccttgaacactaaatcattccctgttgcactagaaaacttcatttgccttatgtagctgaagtgacctgaaggaaggctctgctgaacctttgctagatggcaaaatacagccccactgtggaaacttcttgaactatattgaaccttctaaggaaactaagcctaagaaggaaagagtatacatgcctaatttaaaatcagctttagagactgaggatgagttctttcctgcttcacgaattttccatgaatctaaaaattgaactagactttagaacatgtaccttatcacattagttaattcaaatgtttattctctactagagccatttctgtctttaagtatgagccattctactttctctggatttcatggccatggactgccacccaaatcctagtcagtcacctaaaaaatgtgtgctattgacattaaaggaacgagggtggtgaaagtagggagagatccatgcaaacccatcaacacttctggaaagaaaccaaagcattctgaaagtgggtgaacaacgttttcatgtgtggaaatgtagagaatttgggaccattatgagtgacacgaggagctcagtgacttaccagtatttatatggtgcttcctaaggcccaggcaagcactttttcatcaaaaaaagacatttcaaaaggactttttcattactgtatagccaccacccataaagatttagtacagtgctgctttagtttgaaaaatggtgcccctccaaaatttatgttaagacaatccccaacgcaacaggattaagaggcgtggcctctgaaaagtgattaggtcatgaggattccaccctcgtggatgagattcgaatccttataaaagggctggaggttgaagggagcactctcttgcccttccaccttctggccatgtgactacacagtgtccatcctctcagagagaggcagcaaaaaggcaccatctttgaagtgaagacctggctctcagcaaacacaaaacctgccagtgccttgatctccctgcctccagtactgtgaaaaataaatttctcttatttataaattacctagcctgtggtattttgttatagcagcacaaatggactatgacatgtgcatatctttaaaaaataaaatatttgtaatggttgatttacacattaaattcatattctatatcctccaaagtctgaaccaaaggtaagatgtatttagaatacattgtcaagagctgtacatctattcttttattaaatcctaactccaaactgaaaagctgttgaagaatttttttccattttatactatatagctgagaaaactaaacctcagaaaggttaagtcattagttcacaatcacagtgctagttaatgttagaatctgaattcagcatgtcttccctcagagtctgcattctatctgtgcccccaaactaacttccaacattaccacccttattttctacggaccaatggggcttttctttggggctggaatcatctcctcactaccccctggcatactattcccactttgttcctgccatttcttctgcccctgaaatattcctcaaatggtcattctgcttcatcattccaaaaggaagcattctgagctcaaaacaaaacaaaactaaacaatgattcaccatgttgattcacaacaaaactataaatgactccgttttctggtttgtcaataagcttcagaatactgtcgaaacacataaaatacaaaacatttatattatcaggctaatggttgcctgtgacccaactaagaccaaagtcagacataatgcacacatttcagaggaatttcccaactaatccaaaagtcaagggcttccagatatttccatcacccacaagtggcattcccttagaatgctaagtcttgagccctttccaagtgttgttccctaactctgtaacactccctgaacatgccgcttggtctacctggcaaaccagaattaatcctttaagacaatggttaggtagtgcccccttctttgcttgtgtctctccacttccaccacacaccttgatgtagagtccctattctcactgtacacatacctctcccactagcttttgagctctttgtgggcatggacatgtcttcttaaactttttatcccaaggcccaccaaagaatctgcacatacattaagcccaataaatgctgaatgggcacgctcatgacctacagatattgacactgtgattgaaaaacttctggattcaggaatggggtgtgtttatttttataatatccagccaaatatcaaaggtctagagaagcttctacaggcatatcttggagatattgtgggtctgttccagaccaccacaataaagtgaatatcacaatacagcaagtgacacaaatttgctttccagtgcatatagaagttatattacactgtagtctataaactgtgcactagcattatgtctaaataaaagtacatatcttatttttaaaatattgctaaaaaacgctaatgatcagctgagcctccagcaagttgtaacctttttactggtggaaggtcttatcttgatcttgatggctactggctgatcatacagtggtgtcagctgaaggctggggcgactctggcaattttttttttctcacttttttttttaacatttattttaagctcaggagtatatgtgcagctttgttatattggtaaacttgtgtcatgggggtttgttgtacatattatttagtcaccaaagtattaagcctcgtactcattagttatgtttcctgatcttctccctcctcccaaccttcaccctcttgtaagccccagtgtctgttgttcccttctatgtgtccatgtgttctcatcatttagctcccacttataagtgaaaatacctggtatttggttttctgttcatgtgtcagtttgctaaggataaatggcctccagctccatccatgttcctacgtgttcttttttatggctacatagtattccaggatttagctgtatcactttttctttatccagtctatcagtgatgtacattttggttaattccatgtctttgttattgtgaatagtgccacaatgaacatacacgtgcatgtgtctttatgacagaatgacttatattcctttataacagcatggtttatattcctttatgacagaatgatttatatcctagtaatgggattgctgggttgaatggtatttctgtttttaggtttttgaggtatctgtcttccacaatggttgaacaaatttacatttctaccaacagtgaataagcattcctttttctccacaaccttgccagcatctgctatttcttgaatttttaataaaagccattctgactggtgtgagacagtatctcactgttttgatttgcatttctctaatgatcagtgatgttcagctttttttcatatgcctgttggctgtgtgtatgtctccttttgaaaagtgtctgttcacatcattcacccactttttttttttgttacagggcacatgtgaaggatgcacaggtttgttatgtaaatgtgtgtcgtggtggtttgctgcacctatcaacccatcttctaagtattaagcttagcatgcattagctatttttcctgatggctccctcctcctgacctcaccttgacagcccccagtgtgtgttgttcccctccatttccatgcattctccttgttcagctcccatttataagatcatgtggtgtttggttttctgttcctgcgttactttgctgaggataatggcttccagctccatccatgtccctgcaaaggacaggaactcattcctttttatcctgtgcccactttttaatggggtttttttttcttgtaaattggtttaagtttctcatagatgctggatattacacctttctcagaagcatagtttgcaaaatttttctccctttctgtaggttgtctgtttactctgttgatagtttcttttgctgcacagaaactctttaattagatcccatttgccaatttttgcttttgttgaaattgcttttggtgtcttcatcataaaatctttgcctatgtccagaatggaattgcttaggttgtcttacagggtttttataggtttgggttttacatttagtctttaatccatctttaggtgatttctgtatatggtataaggaaggggtccagtttcagtcttctgcatatggctagccagttatcccagcaccatttattgaatatggagtcctttccccattgcttattcttgtcaatttcatcaaaggtcagatagttgtaggtgcaaggccttatttctgggctctctattctgttccaatggtttatgtgtctgtttttgtaccagcaccatgctgttttggttattatagccctagagtatggtctgaagtcaggtagcatgatgccctgagctttgttcttttcgcttaggatcttcttgcgttttgggctcttttttggttccatatgaatttttacatagttttttttctagttctgtgaagaacgtcattggtcatttgataggaataacactgaatctataaattgctttgagcagtatggccattttgacaatattgattcttcctatccgttagcatggaatatttttccatttgtttctgttacctctgatttctttgaaaagtgttttgtagtcctccttgaagagagctttcaccaccctggttagctgtattcctaggtactttattcttttgtagcaattgtgaacgggattgtgctcttgatttggctcttggccaaactggtataaagcatttctagtttagttactgtcgttggtctaaagtaatgctagtgatttttgtaccctgattttgtatccttggactctgaagttgtttatcagctgaaggagcttttgaaccaagaatatgaggttttctagatttaggatcatgttgtctgcaaacagaaatagtttgacttcctctcttcctatttggatgccctttatttctcttgcctattgctctggacaggacatccaatactatgttgaataggaggtgtgagagacagcatccttgtcttgtgtccgttttcaagagagatggttccagcttttgcccactcagtatgatgttggctgtgggtttgctatagatggctctcattattttgaggtgtgttccttcaatacctagtttattgaaagattttaacatgcaggggtgttgaattttatcaaaagccttttctgtatctactgagataatcatatggtttttgtctttagctccatttatgtgatgaatcacatttattgaattgtgtatgttgaaccaacttgtataccagggataaagcctacttgattgtggtggataagctttttgatgtgctgctggatttggtttaccagtattttgttgaggatttttgcactgatattcatcaaggatactggcctcaagtttttttgttgttgttgtgtctctgccaggttttgttatcagaatgatgttggcctcataggatgagttagggaggagtccctcctcaatttttgcaatagtttcagtaggaatggtattagctcttctttgtacatatggtagaatttggctctagttctgtttggttggtaggctatttattactaattcaattttggagctcattattggtctgttcggggtttcaatttcttcttggctcagtcttgggaggatgtatgtctccaggaatttatccatttctttgagattttccagtttatgtgcataatgttctctgatggttatctgtatttctgtagggtcagcagtaatatcctctttgacatttctaattgtgtttatttggatcttctagtttttcttattagtctagctagcagtctacctattttagtaattttttcaaaaacccactcctgaattcattgatattttgaatgttttttttcatgtctcaatctcagttcagctctgattttgggtatttcttgtcttctgctaactttgaggtttgtttgctattggttctctagtccttttggttgtgatgtcagcttgttaaactgaggtatttctaacttttgatgtgagcatttagtgctataaatttcctgcttaacactgccttagctgtgtcccacagattctggtatgttgcatctttttttttttctcacatgctcagctgtccaaggttggcttccccactgcacactcgagtggtatgttgcatctttgttctcaatagtttcaaagaacttgatttctgccttaattttactatttacccaaaagtcattcaggagtaggttattctatttccatttaaatatatggttttaagtggatttcttagtcttgttttctaatttgattgtggtgtggtctgagagggtggttattataatgagcctagtactcattatacagcatttggtgaggaatgttttgtgtccgattatgtcattgattttagagtatgtaccatgtggcagtgagaataatgtatactctgttgcttttggatggagatgtctgcagatgtctatcaggtacatctggtccagtgctgagttcaggtcctgaatatccttgttaattttctgccttgatgatctgtctaatattgtcagtgtggtgttgaagtctctcactattattttgtggttatctaagtctcttcataggtctctaagaacttgctttatgaatctggatgctcctctgttgggtgcatatatatttagattagttaggtcttcttgttgaattgaagcctttaccattatgtgatatcctttttgtaatctttgctggtttaaagtctcttttgtctgaaattaggatttttctgttttctgtttgcttggtagatttttctctggccctttattttgggcctatgggtctcactgcatgtgagatgggtctcttgaagacaacgtaccaatgagtcttggttcctaatccagcttgccactatgtgcctcttaattggggcatttcacccattttttaaaatcttttttgtgttaaatatttcttataattccttttattttttacttttaacttcagaagtacacgggcaggtttgttacataggtaaacttgtatcacgggggtttgttgtacagattatttcatcacaccggtattaagctagtattcattagttatttttcctgatcctctattttcgcataccctccatcctccagtaggtccaagtgtgacttgttcccctctatgtgtccatgtgttctcaccattcagctccaatttataagtgagaatatgcagtatttggttttctgttcttgtgttagtttgctaaaaataatggtctcagctccatccacatttttgcaaaggacatgatttcattcttttttatggctgcacagtattccatggtgtatatgtacattttctctatcgagtctattattgatggacatttaggttgattccatgtctttgctattgcgaatagtgctgcaatgaacatacatatgcctgtgtctttatgacagaattatttatcttccttccagtatatacctggtaatgggattgctgggtcaaatggtatttggttttaggtctttgaggaatcaccacactctcttccacaatggttgaactaatttatacacccatcaacagtgtatatgcatccctttgtctccacaaccttgccagcatctgttatttttttgacattttaataatagtcattctgattgagaattatatctcactgtggttttgatttgcatttttctaatgatcagtgatgttcagcatttttcatgattgtgggctatatgtatgtctcgttttgaaaagtgtttgttcatgtcctttgcccactttttaatggggttgtttttttcttgcaaatttgtttaagttccttatagatgctggatattagaccgctgtcaaatgcatagtttacagaaattttctcccattgtgtaggttgtctgtttactctgttgatagtttcttgtgctgtgcagaagctctttcattttattagatcccatctgtgaattttttattttgttgcaactgcttttggcatgaaatctttgcccatgcctatgtcctgaatggtactgcctaggttgtcttccggggtttttacagtttttgattttacatttaatccatcttaacttttctatatggtataaggaggggggtccagttttaaccttctgcaaacgcatttagcccatttacattcaaggttagtatttatatgtgtgggtttgatcctgtcattatgatgttagctggttatcatgcagacttgtttgtgtggttgctttatagcgtcactggtctgtgtacttccgtgtgttttttagtggctgataactctttttccatatttagagcttccttgagaagctcttgtaaggcaggttgggaggtaatgaattccatcagcatttgcttgattggaaaggatcttatttctcctttgcttatgaagactcgtttgacaagatatgaaattctgggttagaatttttttaggaatgttgaatattggtccccaatctcttttggtttgtagggtttctgctgagagatctgctcttagtgtgataggcttccctatgtaggtgacctgacctttctttctagctgcctttaacatttgctctttcattttgaccttggagaatctgataattatgtgtcttggggatgatcttcttgtgaagtaccttactagggttctctgcacttcctgaatttgaatgttggcttccctacctaggttggaagtgtttccatggatgatatcctgaaatacattttacaagttgctcatactctcctcatctctttccaatcagggacatcaatgggtcacagatttggtctctttacagaactccatatttttcagaggttttgttcattcatttccattctttattctctattcttgtctgactgtcttatttcagaaagccagtcttcaagctctgattctttcctcctcttgttctgctctgctattaataattgtgactgcaccatgaaattcttgtagtgtgtttttcagctctattagggtggttatgttcttttctacactggccattgtgtctgtcagctcctgcactgttttactgtgattcttagcttccttggattgggtttcaatgtgccctgaagcccagtgatctttgttcctatccatattttgaattttatttctgtcatttcagctatctcagcccagttcagaacacttgcagttgtttataggaaagaaggtactctggcttttgagttgtcagtgctcttctgctggttctttctcatttttatgagctggtgcttcttcaatctttgaagttgctgactgttggatgtttttattttccttttatcttacttgatgaccttgagagtttgtggtataaggtggatttagtctactggtttgtttctggaaggttttagggggccaacactcagctcccaacctcaggactgtgtgctcatagtgcagtggcagcagcattcttcctcatttgcatatgccagcagcagtgacagcgcagcagggtacatgctcatcagctgtgacagggtaccagtgggttactgggtgcctgcctccgtgcaggtgttcaccacagtggtggagacagcagggttccagaggttggggacccctgctggtgattattacacatgattgtgctgtcttggggatgcataggggcagggtgctggtgggtacaggtctgtatgcattctctgtgaactgcatgaaggggtggtttctcagggtaggggagggtctgctgttctctgtgcctagtttcacttctgtgtcagtgttggtgcaaggatgtggtgctagtgggagtggggctgattttccatgggtccaccaacactctgactgcaatggtggtctggcaggggaagaaagagcagagtgcaaccccactgcggcagtggcagaggagggtgcacgcacacaggcacactgacagaacaaaggtggcaaaacctgctcccatacacacgtgctggcaaagcaatgtgggaggttgctttgggccctggggaagtggctgtgcggggagggtgtgggtgggctggtgtgtggctgtgggggttgctctgctggagctctccactagtcaggcagggtccaccagtgcagaagctatgatgtgggcccccagggtacccgaggctgccctgcaagtaggtgtggccaggctgggacctaggagaggccagcacaccaagtggtgctcagatcagactggcgccatatggtgggtaagaccaccctgcagagttcaggtccaacagttcccctagggctaaggtctcctatgggagcaagtcgagcctagggagatgggcttccctggcagtgctctactacagacactcccacaccaagagctctgggctccacttcagctggcatgaggctcctaccacttctctaagcagccagaggcccgtggtgaaagtggcttgctccttgccagttcaactcaccagttcccctggagtctttaagggccaggaatgagtcccggtgcatggtaatcctgtgcagaattccaagcttcctcccacttcagcccagcttctgtgtcttccttccatctactctcggtgccttccctctgaatatctgttaggagtgtgcgccagtgtcttggtccatcagtggtagctgttcttcctgggtccatctggttggccatcttgctctctccctgcaatttcttaactaaaacagcattaatcaactctcctttaaagaaatagcatgggatgccatttagcattttgcccatagtaagatttccttcaaaactggagtcaatcttctcaaacactgcaactgctttatcaactaagtttatggaatattctaaatcctttattgtcattccaacaatattcacggcatcttcacaaggagttgttccacctcaagaaaccactttcttgatcacctataagaatcaactccttatctattaaagttttattatacgactgcagcaattcagtcacatcttcaggctccacttctaattcaaattttgctgttcacaccacatctgcagttacttattccactgaagtcttgaacgactcaaagtcatccataagggctggaataaactttttccaaactcctgttaatgttgatattttgaccctcccccatgaatcataaatgttcttaatgacatctagaatgataagtcatttccagacgactttctatttatgcaacccagatccaccagagaagtcactatctatggcatctatagccttataaaatgtagttcttaaatagcaacacttgaaagtcaaaattaaacattgatccatgggctacagcaacggtgttgtgttggcagccaggaaaacaacattcatctcctagtacatctccatcggagctcttgggtgatcaggtacattatcaatgagcagtagtattttaaaagaaatctttttttctgagcagctctcaacagtgggcttaaaatactcagtaaatgatgctgtaaacagatgtgctgtcatccagacacattgttgttccattgatagagcacaggcagagtcaacttagcataatatttaagggccctaggatttctagaatggtaaatgagcactggcttcaacttaaagttactggctgtattagcccctaacaaaagaatcaccttgtcctttgaaactttgaaaccacgtattgacttctcctctctagctatgaaattcctagatggcatcctcttccaatagaaggctgttttgtctacactgaaaatctgctgtttagtgcagccaccttcataaattatcttagctatatcttctagataacttattgcagcttctacacaagcacctgctgcttcaccatgcacttttacattaggctccttctcatgaagcaacctctgctagcttcaaacttttctcctgcagcttccttacctctaagacttgacagaattgaagagagttagggccttgttctggattaggctttggcgtaagggaaagttatggctggttggtctgatcttccatccagacccctaaaactttctcttttttttgtcaaataaatataatcctttattaaatgaaattttacaagaacagtttaacccctaaaactttctacatatcacaataaagctgttttgctttcttatcatttgtgtgttcaccggagtagcaattttaatttacttcaagaactttttctttatactaaaagcttgattatttggtacaagaggcccagctttcagcccatcttagtgttagagatgccttcctcattaagcttaatcatttctaccttttgagttaaagtgacagatgtgtgactttttcttctacttgaacacttaagaggccactgttgggttagtaactggcccaatttcaatatccttgtgtgtcaaagaatagggaggcccaaggagaggaagaagacagggaaacaggtggtcagtggcgtagtgagaacacacacatttgtcaattaagtcccctgtcttatatgggtatggttcatggcacccaaaacaactgcaatagtaacatcaaagattacagatcaccatagcagatataataataataaaaataaagtatgaaatactgtgagaattaacaaaatgcgatagagatacccagtgagcacatgctgttgggaaaatggttctgataaatttactggatgcaaggttgccacaaacttgcaatttgtaaaaagcacaatatctgtgaagtgcaataaagtgaagcacaataaaacaaagtgtgcctgttatgtttattcacagctaagcctattttcaaggaagatgatggtcagcactcaccagaaaggctgtgctaatatagctctcttgctatgcaaaccattgtggcagggtatgctaaattctacacaggcagcagaaccttctgtagaaactatgggaggatgtgaaacagaaaagaaagcaaaaaatctcaagtggtgaatccacaaaaaaaattaaggtagcacaaatcaaaaatgagaaaccaagtggagactaggggccctgtggaaataacattatgatgacaaattcttctgtgtctaaacctttgtggatttctggctaggattatttctaatagcaatactttgtgttctcattcctttctccttttcatctactcaaaaatagtacatcaaattattaagcaaagaataaagttaaaaatatgttgttttttaaatctaataaacaagctatttgacaattcaggaacatgaagttgaccattatcaatgtaattacattaaccttgtgccaactgagtctcctcctccttccctaatttctctcttcatagcaatcagagctttccctagtatttttttagtgtgtgacctacatctgagtttcccaatttgctttggtggagggaatcaaaaagtcagtttctacatccaataaaatctaccgctgagattttggattgatataaaactgagaggaagaaaaaagtggaggtggttttgtggctgccttggagaggttcaattaatatcttggcagagattcccagctatcctggaagttttccctaccttgggagtcttggtaaaatgctatacaggtaattcccctcagaggctggactggagaggtgatttaagccaactgggagtcaactacgaaccttacattggagaataaagtcaaacagctataaatatataaggtctccaccccagatgaatcaaagtcatcccacccctcttaagtgtcttcataataattctgtgatgtggtggtttagagtacaggctgaatgacagaagatatattctcatctcagcccttatacatacttgcacaatgtataataaccaaattacttaatttacctgagtcttgcttttctatctaccaaatcgggaaaataatacctacttcatagggttgtgagaataaaatgatgtaagaattaaacaaaataatgtacgtacgagtttgccacagcagttagcatctagcagatcttcaatacaacctaaaatgcaatctattttatccttttccattcttctgaatgataaaagtcatcaaataaatgataatgatgataaatatgatcattttggactggatgtgtatgtctccccaaaatcaacattttgaagccctaaccccaagtataactgtatttacagatggggcctctaaggaagtgattagggttaaataagctcataagggtgggaccctggctctaataagattggtggccttataagaagagacaccagagagcttctgctctctctccttccacatgcacacactgaggataggcaacgtgaggacatagtaagaaagtggtcatctgcaagccaggacaggagaaaccaaatcagctggcaccttgctttaggtgccatgaggaaataaattaatgttgcttaagccactttggaaccatgagaaaataaattaatgttgcttaagccacccagtttatactattttgtgacagcattccaaacatacaaatataatgatgatgatgacaaacgccttattccaacaaaggaatagactagataaggaatgataaattatatttactagatgtttgttttttgtttcaactttcccttgcaggtcactttggtgttgctgatgaaggcacattagcaaactgggcccaatcactgtacatttttgcagaggctattgttctaattaaaatctaatgccctgagccactaatgatgacaggacagttttcagatccaagaccactaaggctccaagaagagctagatattagaggaagtttcaggaagaaatatggtctgactacattaaggagccgagtcaaagtcagagtgcacaggttacaagtaatctagggttgggagtggagggatggacagtctggaggagaaaacaaaagttgtaacaacaacaacaacagtgacagctgtcagtgtttctgctctatgcaggcattactgaattatttccaatcctccctgaagcactgcaaggtaagcatcttcattctcattttattctctttatatagaatgtacagaaatgatactttgtaacccaaatctgatacagattttgattcataacccaaatctgattcatgaaagggaattctctgttgttcaaaaacaaaataataccaagttttttcatttgtacctgctccagttgtgctcccctttcagtaaatgtatctccaaagtcccacctagagataaaatatcaatacatgttaaacaagaattaaagtaaaagtgtgcatttttagatagttcctctaaacagctaagctgctctggaaatacctcttaaagtttataaatcatttccctaaaaacacccacgagcagctcaaataactcaagaaacaggagagaggaaacaagaagactgaaagaagacttgaaaacctaaaagccccaagtccaacttcagcgaagagaagtaaagtccaaacaacaatgtgaattggcagggtgttgacggggctgccctctgggccacagtagcaatctcatactcaaattgtcatcactagccttttatgttaatctttctaccagcatttggtaatctgatataatcacaaggaaaaagtgcttattcccccatacggtgaggaagtccctgccctttggaattttgtctgccatagaactgaacatattatcacaaatctgtttttcttacagtgaagagccatttatatattcttaattagtttgtttctgcctgtattgagaggaattatcttttaccaagaagcccaaaagaaaaactatttcatttcctcatgacagacattaacacatggcattctaagacaaataaacatgttacacttttacaacagaaatagagaaaaaatcctttcctaattaatttataattagttttctcttctggagctctaacttgtattggactttgagtaagaaaaaaaaaatccttaaaaagtaaaagttcaactttggttctatcaggtttgatatccagaagaaaatgcaaacttccattgattacactgcaaaacatctactactctaaggacaatggctgtttaaacgcctgaaataaagaatcaagagtggaccacacttgaagaagctaacaggtagtaaggcacttttcaaacacaatgggatggttaacataaaattaagaatgcatagatttcataactattgctggtaaaaagaaaatgtaaacaaaaaaatagaacttactgctcatttatttaaaacattaagtaacaaattatagaaatgtcatgtaatagtttcatatttaaaccttcacaatatttatttataaggggaaaatttatatttttagaaatactactctctttaaatgatgcccagaaatcctactaaaaatctactctgtaacttaattctacggagccattttagaaatattaaaaatatgaccacccctagttaaaatgtatactttcccccaaaaaacttcaattttaagaactacatttatttttgtacaagcaatatacacacacacagtaatcacttaaagtgtatgacgggatatcaatggatgaatctggagaaataggactctttatctccaatcacacattgtaagcatggatattggcctctcactagagttttattactcagattatttccaataaataaaatgtcttaaaaacaacataattgggatcaatttagtcccaatttccatgtcataaaatcagactccaatccttcttcaatacaagaagcttacttttcatttacctctaaattcacgatcagtgaccacagggttgagatggaattgctgagagtataagctgctgcctggggttggaagtaagcaatcttttcttctttctgggaatactaatgcttgctagaactctgccaaaacaggggttctcagcccttgctgcttcctagaaccctttcggcttttaaaacctactgatgcttggaccctgacaccacagcttaacaaatcagaatctctagaaatagggcctgagcattgttatgtttataaaagcttcccacagaattctaatgtgctgctggggaagagaccacacatatataaggctttgagatggatggatgttacatatagtcagcttattattgttgacatggtggtgaaccaacagggttgagtggaagaaaaatgagggtaagtttccatgatgaagtgataactactggagaaggctctatctatagatataagaagatggagtcaatagtcaggagactgtaagtcctggggatgacttcataaccagcaagctgtatgagttcaggcaagtcatctaagtccccggggtacagaactgagggagaaaggagggtggagggcccaccactcccaaccaaggcagccatacctgtatttgttttatatgttaggcttctgtgtgaaacttcacttcatgaaagagttctgtggccaaaaccagtttgaatacagccgatctagatgttctttaaggtctcttctgagataattttgcaacatcccataaatatctggaactggcccaccaggcctacatagaaaagaacttaagacaatcacaatgatgcttgctctccgcagttactcttcccactggtttattttgtgggcagaaggcttttatccaaggtccacctacaaacacagtggctcttccctctccttttatctgtcaggtactcaataactgctgtgatttttccctcttaacactgcacctgactacacccccttacaggtcaattctgattacctgtaaagtaaatgtcaactcacattgagattacagagtacatttgaggctctaaaacatttttctggagacaaattttcactatggaataaagaggataaatgtgtgccagctctctgttgagtttactcatccaaatgaaccttccaccataggaggctgacttgcaggggatgacagaagcagattccccagtcctctgacttcccgtcagggccagcaaggaggagccctgacaggaaaccagaggataggaaaggagggaagctggtatacccattttctgggcttactcctggtggggctgccacagattgactgtgaccttcaactggaattctccattcttctcaaagtggctgtctccttgcaggttgcagtaattactccccccatcacatttatgccaactggtgaaaaccatcttggcttttatcagggttgctcacactctactctttgcttttaaatagttcctttattgaaccttccatgaattatcctaattttaatgagccattttctgatagactcctgatacctgacacatatttgttaatcaaggatttctacggaggagccaagatggccgaataggaacagctccggtctacagctcccagcgtgagcgacgcagaagacaggtgatttctgcatttccatctgagacctacagctgagggtcctgtctgttagaaggaaaactaacaaacagaaaggacatccacaccaaaaacccatctgtacatcaccatcatcaaagaccaaaagtacataaaaccacaaagatggggaaaaaacagaatcgaaaaactggaaactctaaaacgcagagcgcctctcctcctccaaaggaacacagttcctcaccaaaaacagaacaaagctggatggagaatgactttgacgagctgagagaagaaggcttcagacgatcaaattactctgagctatgggaggacattcaaaccaaaggcaaagaagttaaaaacttttaaaaaaatttagaagaatgtataactagaataaccaatacagagaagtgcttaaaggagctgatggagctgaaaaccaacgctcgagaactacgtgaagaatgcagaagcctcaggagccgatgccatcaactggaagaaagggtatcagcaatggaagatgaaatgaatgaaatgaagcgagaagggaagtttagagaaaaaagaataaaaagaaatgagcaaagcctccaagaaatatgggactatgtgaaaagaccaaatctacgtctcattggtgtacctgaaagtgatggggagaatggaaccaagttggaaaacactctgcaggatattatccaggagaacttccccaatctagcaaggcaggccaatgttcagattcaggaaatacagagaacaccacaaagatactcctcgagaagagcaactccaagacacataattgtcagattcaccaaagttgaaatgaaggaaaaaatgttaagggcagccagagagaaaggtcgggttaccctcaaagggaagcccatcagactaacagcggatctctcggcagaaaccctacaagccagaagagagtgggggccaatattcaacattcttaaagaaaagaattttcaacccagaatttcatatccagccaaactaagcttcataagtgaaggagaaataaaatactttacagacaagcaaatgctgagagattttgtcaccaccaggcctgccctaaaagagctcctgaaggaagcactaaacatggaaaggaacaaccggtaccagccgctgcaaaatcatgccaaaatgtaaagaccatcgagactaggaagaaactgcatcaactaacgagcaaaatcaccagctaacatcataatgacaggatcaaattcacacataacaatattaactttaaatgtaaatggactaaatgctccaattaaaagacacagactggcaaattggataaagagtcaagacccatcagtgtgctgtattcaggaaacccatctcacgtgcagagacacacataggctcaaaataaaaggatggaggaagatctaccaagcaaatggaaaacaaaaaaaggcaggggttgcaatcctagtctctgataaaacagactttaaaccaacaaagatcaaaagagacaagtccattacataatggtaaagggatcaattcaacaagaagagctaactatcctaaatatatatgcacccaatacaggagcacccagattcataaagcaagtcctgagtgacctacaaagagacttagactcccacacattaataatgggagactttaacaccccactgtcaacattagacagatcaatgagacagaaagtcaacaaggatacccaggaattgaactcaactctgcaccaagtggacctaatagacatctacagaactctccaccccaaatcaacagaatatacacttttttcagcaccacaccacacctattccaaaattgaccacatagttggaagtaaagctctcctcagcaaatgtaaaagaacagaaattataacaaactatctctcagaccacagtgcaatcaaactagaactcaggattaagaatctcactcaaagccgctcaaatacatggaaactgaacaacctgctcctgaatgaccactgggtacataacgaattgaaggcagaaataaacatgttctttgaaaccaacgagaacaaagacacaacataccagaatctctgggacacattcaaagcactgtgtagagggcaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagaggcacaaaaaacccttcaaaaaatcaatgaatccaggagctggttttttgaaaggatcaacaaaactgatagaccgctagccagactaataaagaaaaaaagagagaagaatcaaatagacacaataaaaattgataaagaggatatcaccaccaatcccacagaaatacaaactaccatcagagaatactacaaacacttctacgcaaataaactagaaaatctagaagaaatggataaattccttgacacatacactctcccaagaccaaaccaggaagaagttgaatctctgaatagaccaataacaggagctgaaattgtgacaataatcaatagtttaccaaccaaaaagagtccaggaccagatggattcacagccgaattctaccagaggtacaaggaggaactggtaccattccttctgaaactattccaatcaatagaaaaagagggaatcctctctaactcattttatgaggccagcatcattctgataccaaagctgggcagagacacaaccaaaaaagagaattttagaccaatatccttgatgaacattgatgcaaaaatcctcaataaaatactggcaaaacgaatccagcagcacatcaaacagcttatccaccatgatcaagagggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaacaataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagacgacatgattgtatatctagaaaaccccattgtctcagcccaaaatctccttaagctgataagcaacttcagcaaagtctcagggtacaaaatcaatgtacaaaaatcacaagcattcttatacaccaacaacagaaaaacagagagccaaatcatgagtgaactcccattcacaattgcttcaaagagaataaaatacctaggaatccaacttacaagggatgtgaaggacctcttcaaggagaactacaaaccactgctcaacgaaataaaagaggatacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcatcaccaagtcaatcctaagccaaaagaacaaagctggaggcatcacactacctgacttcaaactatactacaaggctacagtaaccaaaacagcatggtactggtaccaaaacagagatatagctcaatggaacagaacagagccctcagaaataacgccgcatatctacaactatctgatctttgataaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaaggttagacctaaaaccataaaaaccctagaagaaaacctaggcattaccattcaggacacaggcatgggcgaggacttcatgtccaaaacaccaaaagcaatggcaacaaaagccaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatccaaaagtgggcgaaggacatgaacagacacttctcaaaagaagacatttatgcagccaaaaaacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatctcattactgggtatatacccaaaggactataaatcatgctgctataaagacacatgcacacatatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcacaagaacaaaaaacgaaacaccgcaaattctcactcataggtgggaattgaacaatgagatcacatggacacaggagggggaatatcacactctggggactgtggtggggtggggggagggaggagggatagcattgggagatatacctaatgctagatgacgagttagtgggtgcagcgcaccagcatggcacatgtatacatatgtaactaacctgcacaatgtgcacatgtaccctaaaacttaaagtataataaaaaaaaaaaggatttctacttctaggtatttaaagaaataacgagatgcacgcaaaatttcaggggtgttattaacgactttggacagatatatcacaatcaggactaataggaaaggatgctacctataccacctgctatgtgcccttagcttactggatcatcagcagtccaggagagggaggcggggaaacacaggatatgactgttttctcatcaatatggaaatatttcagtattttaacaaccagtgtggctaaactggctgacagtcaatcctacaaataataatccttatgcagaatgacataacagcaaacaaaactggaaaaaatatattttcaataataaattattatttatcataaaccataaaggttcatatcatagaatgcaatgaagcataaaaaaatgtcttggacaagtatttactcatttgtgaagatacaaactacttagcaaaaagcagagcagttacaaaatatcataggctgtacaatctcaattttatttaaatatgtatgtatacatatatttacatctttaagtaaatagactgaggaactatatcaaaatgctaatactaatgtttatgagtagtggaataataatttaattttcttctttacaaatgtatgttttccaaaatttctgccattaaactgatgtattttatagcaaagataacattactttttaaaaatggagcacagtaaaaaaaaagctgctacattttaaactgaatcttaaaaatcttttagttactgtgctaaagcattttcacttcttcagaacaaagatttactactttaccttgatatatcagggaatagagaacagagatgaacttgaagcagttcggcatcactgacctgacaaccaagtggagatggttgtcagataaaaaaataatgaatcactatgatacaagcaaaaccagaaatatctaaagatacaaaaatacagggaaaagacataaattttttttctggaaggaggtcatggaaagcttcacagaggaagtgatgactgagcaggattctgaaggctaaacaggagttcaaaaaccagatatggcaggatgaagcttttctaggaaagaaacacccccatgcaaatgttctcgagcatgaaacagccaggaactaaacagatttagctctgctttctttctcctaaaatagaaacttgcaaggatcttgactttgactggaaggaataagcatttatgaaaaacattctaagtgacaaaaattgagctagtattttgttttgtctttaatggaggaaatgagaaaactgaggctccggtaagtaagaaccctcttagatattcctggaatttacaccctgatgggtggttagttactttatctacatagtattctcatgtatatatgctattatcgtattctatcagttgttctcattacatagaaaggattaagataaattggtggtgttcaaggttttggatttacctactagcgcacttcctcattgccacaggagttaaatattaactcatgctgatacctgtccaacatgtatgtacatgtgtgggtgggtgggtttaggcgcaggtggaaatgaagtattgcaaaaatatctgcagtttggtgagcaattaatcaggaaataatgagtgctatactggaataatcaccttaaaagtaaaaccttcaatgaaagcaaatctttcagaagttcaatatgggaattaaattactttaaaattgtagaatgttctaaacttttgcatttattgttttgaaaatatttttcaatggtaggcattttcaatcatttattttattacaaggggttaattctgggattattttttgctacttctcaagttaactatgaaaaccataattctttttttatcttttggttgggtttaattatgacaatgtcagtaatatggtttagttgtgtccccacccaaatctcatcttgaatttccacatgttatgggaagaacttggtgggaggtaattgaatcatgggggcaggtctttcccatgctattcctgtgcttgtgaataggtctcacgagatctcacggttttaagaaggggagtttccctgcacaagctctcttctcttgtctgctgccacgtcagacttgcctttcaccttctgccatgattgtgaggcttccctagccatgtggaactgtaagtgcattaaacctctttcttttgtaaattgtccagtctcaggtatgtctttatcagcggcatgaaaacagacttatacaatcagtgaaggcataactgggaagttaagtatcattaacttggtaaggttattcatgtttcaattataaagaatttaccacttcagatgaactcacctagtttcctttttctcttttctttttttttatttcaatagcttttaaggtacgagtggtttttggtacatggatgaactgtatagtggtgaactatgagattttagtgcactgtcatcagagcagtatacactgcacccgatacgtattttttaaatctctcaccccccactgcctcccactccctcttgagcctccaaagtccattataccactctgtatgccactgtgtacacatagcttagttctcccttataagtgagaatatacaatatttggttttccatttctgagttatttcacttagaataacggcctcaaaatccatccacattgctgcaaaagacattatttcattcttttttatggctgagtagtattccatggtgtatatatattacactgaaaaatgtaattctttaatatgtctatgtgagccaaaatctacaaatggttaatgcagatattaggtcaagtgtcactctacagtctcctgaatagtacagaaatcaaatttatacccagtgcaattttttcaccattaagacattttatttggccgtgaatttatttggccaagacaataaattcagtttttcttcagcatgaaccaaattactttcttagatgcacattactttcctccagttagatctctgttttttgaatcccaggcatcctaaaagaatattttgttaattctactatagctcaatcttataccacttgacttcaatgggccactatgaaaaaggaagctgagttgagttcctttaaagtcgtaaaaagtaaattaacattgaccaagcactttgaggataaaataaaatgtcgagtaataattattcttaaaataaaaataaaatcacaagaagttgccattctataatttttttgtgatttttttttatctaatatcccccaaagtcaggaggcagtgtagatgtacgaatattgtctgtattttctttcaagtaaatgcaaagccaaacaaacaaacaaacaaaacacaaatgcacttttcacaccacgttttgctctccacaacttttaggccctaagtacatacaagcatgtatgaaaaaacaaatgcacttattttcacacattttgctcttcacaacttttaggccctaagtacatcatgcatgttttaaatgcatcaaagaggcactgcatttaaaagcagtgagacagaaatggaccagataggcttggtgtgatagtgaccacaattccaataactataaaggagaggagaggtggactacatcctctaagcagactctactgagcttcaacactatctgtgctacctaaaataaccaagtgttggaaatcagttcttttattctatcatcaaaaagcatgattcagattgacaatggaaatttgatttatataattattaacaattttaaaaactttaaatagtagatctctcaaaagacaaaatccttggtgcatctagtagtgagaacttaattctaagaatttagaagaacctagtgatttccttgctggaaattataacccacggttaagcctgaggttggatgcccacccaccctgcacccccattatttctgcctactaataagcctttgtactgtgtggcctttccttaaagcacttttttttttttttttttttttacattttcaagtgagtacatagtatgtgtacttgcgggttggggcacctgaagacgaagtgagaagcattgttgagacaacatatcagaaaattcttgcctctagacaatcacttaggggcttgacttctggagaaaaatggcagtttgtcaaatccttgacacacttttaatttagtaattttattagcataatatgcctactagcaaaagaagaaacggaattgtttaaattttccctcattctgataatgaatgtcaaacatttttttaaaacattttaaaggatgagccaacaactttaaaataaattaaaacaccattaatttttagtaggtctatttaaataataattttgatttttgcatactattatttatttagtcttttctgtatcttgcagggtattcctaaatttataatctagtgtccaaagatttaatgaaagctcattgcttataacaatctgagaaaaataatattaacagtataaaggcagaacacagctggctaatttaagtgaatacaatttttaaaagcatttactccattgggactcataattacagtattttgccagtaaatctgtaaacatttcatatcatatgtattaaaagatcatgcttctgaattagtaactcttaaaaggtaaaattaaatattcataaatttcaataatttgaaacaccgcagtttgaaattaattgataaaagtatccccaagtccaggaagataataaattgctatcttctgtgttactgaaatataatttgtattattcctcaattagtaacccctacaattttaactgtggtgataaagtgttctacaatatgcaaggtggcaatttcaaaaccttcccctaaaaccagtattctcaagtcttttaaactcataactaaccaagcagaaaactctcatataaaaagtccagcagagctatgagtggttagacaggttaacgccaacctacagaggaatggaacagaaaatacacatcaaaatcattcagggatcaagggcagcaaactcttgaaatggttagagaaatcatggtgtggcatatttctcttaggcaagcagggtcatttctgagttggtccttctcagtaacccaaatgaatgaatgctcttttaaagtgcccattaactgaggtgcatttttctggctgtttttataaagtgcatgccataacaggtacttgtttggacaaagataaacatcgctttgtgttcacatgcaagtatggcttgtcacttggcactttgtgaattacttctcaaaaagaagtcctactttcagcagttcttgaggaaacagacaagggatctccctacagccactgattttaggaggtagggattaaaagtgtcaggaacagagcatctatttttgctcatgttttaattggaagtatagttaccactcaagccaactggaagcagaaaagccttcaagataatacattagaagaaaagttaagagggacactgaagatcataatccaattgaagaaagaaccattgagtcataggatatgaaaatttggatggaacctttattaaactagacgggatagtctaatagcttcatttaaccaattcagaaaagtataaaaacaagtcttcagtgagacctcttaccctacaagaaatacaaaatctataataaagatcaagtaataaaatagggcttgcagttcctaaccattcacagtggacatgctcccaacacctgcaatatacatacatttttactttctgtgtttaatgctgtttctacaaattctgccacgtgtatatgatcatccggccatgcagtaaaaaagcatcactctaaagtggtatggtctatattggaaagcaagtgttactccagcacctaagtttctaaatacttgaatatttttgcctcccaccagaactgactataaatataattattaaccatcccagacaaactataaagactcaaataaaagtagactcaaaggataaacatattgcatattgaagaatgctactagaatgaatatgtcatcctatagtttggattaatagggctcaaactatgaaatgtgtcatgtcatttcagaaaaagcaaaaaagtttgaatgtagagagaaaggagtaggagttcatatagccactagactcacattttttacatgaaccattgtaggatatgcattttacatcatgacctggtacacaatacatacataactaaaacaaaacttttacaaagcaagacttaccgctatgtgcaatgcactatgatatttctctatttctatttaacttcttaagtaatgctcatggtgacccacaaaactgatttcatgatacactaatgaatcagatccacattttgaaaaacattataccagaagactatcaaatcttcttgcccatggcatattattcataaatcccagcattcttcccagcaagttcagctaagcttcagaacccatttcaaacaagcattccaggcagcgagtatcaactatagttgggacacagtcaccacctaagttttaagaggacaaagtgcagggacagagtagctatttttattattttgcactgtttgtacccccagtgcttgcagagcatccagaacagagcgggcactcaaataaccactaagaggtgaatcagtaaacgaccactaagaagatcagagggtaagcttcggtttctgaaggccctctgtagctccttgcactccatcttttggctactttgctatctttaaatataaagctttcaaaattcaatcactttgagtactgtatgtaccgtccctgctctccaaactccaccttttaataacagttacctgtactaggctacttgatggtgcctctgttattttcaaaaacaattagtttacacttaaggaattaccaaaaaagattacaaatcatgatagagtcccttgataactggaaagaaggacctgccaaaacatggactggatattagtgcatgtattttcttatttcaacccttcaacaatctatttagtttcatatcatcaacccattttactggtgggaaaccaaacacttggaaaaaagaagtgaggtcacacaattagtaaatgcttggcagagccaggattttaaactaggtatttcattgctctttattatacctcagctgctcttaaaaatggcatttaaattacaaagaaacaatgaccagaagcctcaaacccatttgaagtgtgtgaattgttaacaagttatcgtgttggaaaaataaaaccctataacttagtaatatacttcatcacataactttactttttctttgccaaatctttgtgagttattcactgctgggtatgtttttcttggcagctgttaatcttggctccgacataagttcttactgtagagtaattcagatacgttaagtcctctattacacagagaaaaaacaagactctctctcgtgtgtatgcgtgtgtgtgtgtgtgtgtgtgtgtttatattgctcatgtccaagaggaaataaaaaatggaaacaatataaattgggggtgtgtgcatcgggcagttaaaagactttgaaggcagaatcaacaattttggccttttggctctcagcagaagtagtgtaaggaaatggagcggaaaagaacagtacgggtcaggtttaactcacatgcacccccacacaagtgtacgctgcttgacgtagtcacaaaacctgcaatgtgtaatttgcccaatcatgaccatgagtcactgtaaaagttactaagaaggttgttcaaaaaaagcatatttttgttataactttagttctcaaccaggaacaatttagggaacatttggcaatgtctggagacatttttggctgacactactgggtaaaagacagggatgctgctaaacatcccacaatgcacaggacagccccccataacaagacattatatgggcaaaatgtcagtagtaccaaggttgagaaaccctggttttcagtgcaataatatttcgtggacaacacaactactatactccagctgcctctctgatcctgtctcctcatctgtaaaataaagatgattatagtgcctcttcattgtgttgttgtgaggattgagtctgatttatgtaaagcatttaaaactacgcctatgacataagtaggtgctaaataaatgtcactcttatcaccaccagcatcatcatcatcaaagcttaccaccatgcggcatgaccctttattaggtgaattctcggggtgaaagaggattctgtgttaaaataaagttggaaaatggtaggttaaaatcagacaagtttctttgttgtgtaaatgcttggaatctctaataagcaaaaaatataggacatggagaatttcacattgatctgaccaaagaatcctatgcagaatcttgcaggactgaacacttttagggaaaggccggtgtggtgaaagggcatatactgagactctataaacaggattcagctcttgagtctatcacttatctgccatgaagctgggtaaggcccttgactttccttggcctcagtgatcaccaacgcaaaaaaaaaaaaaagcccttccagatcagaaagtctcagcttctctgatgctcctggttgtagcatatcactgcagacctcaaagacatgcactgtcagatgtcaaggacaccagggtcaagcaaaatgaagagctatgacaattcccaggataattatgctccccaaattcctgttactaaggaagctcaaatatccaatgtgggaaatcaagaggaacatgatataaaaactagccttatctgttgtgtttttgcaaatgcagtctaactttttaaacagaaagcaaaactagcaaagaacaatatggtgcaattttttaaaaatctcaactacctaaagtgtagaccagtattatctcctcaattatcttttaggtgctaaataaaatcagcacagaatacggcaagaaaggattgctacctcaaggaactaaaactctatttggggaggaaaatgcacatatatcagacatcccgtgagtgctgacagtttaaacaaagaccaatgggagcagagtcatctcagttattgccatttttgataagtcaaatgcacaacagcaaaatacaaaataaaatttaaaaatgaaatataaacatttatcttttcgtttgggtttccaagtaagtgttttataccaccttattgttcagccatcattgacaggggccaggaaggtatttaaactgcagggtatgtgtactatttgtcattcactatactcttcctccctgagtgcactggtaaaagtttggcctgaatcctccatgcatgacagagatgtacttttctgggatacaaagtgaaatgagtatgcctcgtattgtccagggcacgatttcttcatattacaaccttaagatattttaaattgtataactggaatcttttactctggaagaatagccagtgtacatataggttatcctttcttttaatccattaaagtccatacccatttcatgactctgcatggcatctgtaatcttggggtcagggagggagaaaccaaggtgtatgctaagactcttctgtcctcagcaaccctcttaacccaggtactgcttagattgaacaggccgtggtaactgataagcaacatctgctcatttcctcattgttcactctcatacatgactatgcataaactagtgtcattttctagaattccataggttccactaactctatttctgatgacaaacttgtttgtctttttttctttcgaaaccttatgtttcagatgaatttaaatgtagtccctgtttttcatttccagacacaaaaagagacaatggcttcctcttttcaaactgctttagaatattcttttgttcagaatctctttcaaaatgttgaggtttggttgtctttggtggtgtcccagaatgatggtttacatcatcccgctctcaacctctccccccatgcacaagctttgctttcctagaatataaccactctgctctggtgagcctcaaaagaaaaattctgattttaaaaatctaaagctttaattacttttactatttaaaagccattttccattataaaatttatcatataaatttgtctagttttgtctttaacctttttgctttgacctttgaacataccctgttatcaatgtttttgctattaaagctccttttgtttctttgcattttaatcactgttttgtttcatttgcaaactgactccgttcactgcttagtcctctgttttggttcttttattgtgtccccatgctgaatttcagacactgcaaaatgtgagccctgaaaagggcctttgcatttaccctattcaggagtgcaggatcattaaccaccacaaaataaaaactagttccaacttcctctgccatcagggatagaaagcagtggggaagctctgagagggaaggtagactagagccaaagggaaagcataggtcccggtagtgcttcacctggatatggatgtgtgtgtgtgtatggaatggtagtgtccttgcatgtggagttcccataagttccctagaagagttacagtaacagcagtcacgtgaaacttagcaaggagaccttgaagattttaaaaactcttaggcagccctgaagtgggtcctcagtttacacactgatagcccaggcaactcacccaaagccacatgggagtaaacactagagattcagcatggcaacccagatcccttcctctaatagtaggatactagcaaatactatttgcaaatactatttgctaatactatttgtgaatactatttgctaatactagcaaagcaacatttccaccttattctttggcttttactttttctcttgtgaatttagttctatgaaatcttgtttcagcacacatcttaattatggctggctctgacagttctgtctcaagtccacaacttcaacagactttatacccacacacaagatctatatatccacgccaaaggtcaggtgtgataataatgaagagggaattatcatttttaatgataagctacccacacttgttactatactttgcaagcacatattataattttcataggcaaagacatattatccttttattcattgtctcattcattgttttaataaatgttcaatgaacaccaattttgggttaggtgcctcgaagactatacttatattccaattccagtgccatggctctaaaaacaatgatctatatggttcctttagtatggtcttcagagaaaatttaaatatcagatttagtactttaaagacactatctgcctcttttggtcataaacattaattactacctataccatctgtgtcttttgccagacttggacatgaaggactttgaattagttctaaaaataaaaattaaaatatgtgctatagctgaggacatccaaaatgctgtacaaatgactcccaaacaggtttcaagaagagttccacagatattctgcttaattaatgtgatatataacaaagtaattaagagcagagacatagaaataggaaagacttggattggagtcccagtactacaccatttattagctgtctgacccctttaatctcactaggccagttttcttctctgtaaaataggaacaatcatggcgcttagatgggagggttatttgaagcttatctgcggtaatataagtaaagcatggaacccaggaaatgatcaacagaaagcgctataattgttatcactgctttgacaatcagaagagttggatgcattttattttaatatttacttttgaacaaaatatttggatgaagctgacaccctggcagttttagaaaacagttttgtgttagttctagttagtattttagatgtgatctgaaataaaagtagacaacagtcaattatgtggctctgtttatattttaataatttatttccatttatattttaatatttccagtaaaatttatgtttatagcttagctaatagaactatctaacacatagtaacttgcccattattctgaaatatgtggtcttatcatttctacttcaataaattttgcaaaacaaaaaggccaccaacacttacgattagcataacgaacatcttcaaaaggaaaatttacttttcaaataaatctgttttttaaattattcttaactgggctataactagctctccatttttatatttccttttgacagtgtgttaatttacaaaaggaaatacagaacattagctttgaccaattgataaatacatttattttaaaaggaagctgaatctttaaaatgttttgatcatctttgtcagttcataagatttatggctatttctccagaatttgaaaacctcttagcagcaaaaataaaatttatattaaagatttattattcaaaaaaccatctagttgggtagtcttttatatctctttccgttacctttccatacagtcttcttttgtctacaaaaatattttcagtcatttctgggtattgaaagaaaatatcttttagcttatattatttaatacttaataacattaatatgtcattaaatttttcctcatataaaaactagaaatttatttccagagattaaaaagttatgataaaattctaattattcgattattagaagcaattagaaagctacttaacacatatcagtccaggtattaacctgtaatttttactttgaattacaattcaaactactgtttttcaagacctccatttaatttgcataaacatattcatttgaaaagtgaattaatgttgcagttttcattctgttatatcatcctaatcccaattccaaaagcataaaaagcaatgtaaaattttatcactgttaacgtgctaggaaacatgcagccatgttataaaattattaaagtccagctgcaaaaaagctggggtttgtgtatttgttttcaaattttatctacttccattctcacctataaaaaggaaatgagttttgagtcacggcacagaatatgaaaagaaaatgtcaagtgacaatattaccagtttttacttcaaaaaccactctagttaaaagctacttaaatcctaatttttaaggcttcatttactttatgtggattttacttcagagaactcacacttttagtgctttagtccactgcttcttatatgaaattttttatttagttaatgaagttgagataatcagtaaaaggtttgatcagtgaggcaaaactccccaggataatcattcaataatgactttatgactggaatttctacttcaacatgtgctataactcaaaaatctcaagttattttagatagtaagatcgtaccagtttgacttttggggaaatcaatcctttgcttgtattcaaaccttggactctaaaatagtctcacctcacatactagaagcttctagagcaggactttctgagatgatttctttatcttattttatacatatccaatttactaacgtggcccaagtccacctgaaatttggcagaaataagacgtcagttgtcggattacactggtttttagatgcagttcattttcctttcctgctaccctcctcagaatcaaaattacctctaagcaaagaacctagatttaaaatacaaagaagaaaatccaacacagaattacctaaggagaagtgaaagaacttttctgtaaccaatgctatgccttcttggtcactttaatatttgccattttattgtacttttcccctcttccaaattgtagaagcactctatagaagtaaaacaaaaaagagaactataacgcaaactcttaataattcaaaataagtgaaaaacttagattcttgagccacactcccctatatgctacctaccctggcggacttacaatcaaatcatactttatttctttctaattaggttgaaagtagtatgaacaaggctactgcctatacacaaatggcactaattttcccatttgggtctaagtcttttaacttcaactgttatgcccctggcaaggaagtaaagctgaattggacaagaccaaaacatttcgtgggtttgatttgctgcggatcatgaagttggctttgcaaatggcagagaaggggactccttcactactgctaactcacaggaatcaatgtgaaagagctgtggggaattaagactcagaacttcttaactggctcagattcatatggactcaggcttatcaggcagaactatgatcaacccacgtagcaggttttattaattttccctatacaatctttcaccgctcagtagtcgatcctttgtcagaggcagcacaatcacagaaatggaaactgggccacaaactgcttagcataaatgtttccaaggccaataaaaatggcatttttcccctgccatttgcccaaaagtataatttttattaatataattattattttacttaaagaatcagtgctatttggacattgctcttaaatggaaattacttaataacacatttaatttagaaattggcttctaaattaatgctgacagcttggaagctggtatttagacaaaatagagtaagctgtgtattcgataaagccatgattaaggattttcaaatgagatttattttttctgttgtctgctgtattttagtacaaccaataactacatcctgacaaaaaaattcaattacataataaagcagaaacttctaggaagtccgaaagtaagttttgttctcagactctttttactcccctccatactgcaaaccagcacacatatatacaatcgatttttccccttcatctagactcttaccaaaattattttaataatttcctggactgccttctcacataagatgtggataaaaaagcctcaatatccataaatacagcaagcacttatattgtacaaataaaataactgacttactttctaaacacttaattgtatttaaaaagatgacatagttaagaagtcctcagtgaaactacagtttataacacaaagatcaaatttcgctgtttcttagttaagattgacctaccctagatccaacaaaagttgctgttttttttcctcacttccataaaaatttctgaatcacttgggagattatttctaaggaaatagttgtgaaaccaagaagctgttcaaacttaagcatcaattcttttgttaattcattttatgattaaaagaactaccaaaaacattactctctaagaatcctatcattatatgtattttaaagtgtcttcaaaaagccattttatcttaaagctggatttcattcctcaaatgttaataatctgggattgcatctcttgcttttttacagttaaaatttgtttagagcccccccgatgtttatatgccaaagctacctagatacacacaatgaagaaaaactgtggcaattatatgaaaaatataatgacatctgtcattaaatgtcaatgtttcaagtaaaacatttcttataaaaacctgttactgaagaaaagaactgttaaagtacatgaattaaagtatttttaattatcccaaatacgtaccaaccaaatttaactacagcttagttttttaggcaaaccaagatgactattttttttaatctgagaaaaacatggtatgtagaaaaattctattttattcagttcaacactcttcacttgaggatatgaaatttataagtatgcaatctccttgaaattgtaaaaatataatacacaattttatactaccttctaattttacttcctcaagcatttgttgtagtttctagaatagctatctagccattacactgtacataaaagtgatcctccaatttatttccacttctaaaaagatgcttaaatatagaataaagcatttcatacctcccttctcgtttaaaattccaaaaagggccaacaatccacattataggttaaacactttgtctctgttatacacttttcagaatttataagactgaaaaattataaaatttcatccaatgaataattctgtactttattaaagtctggtttctctaaacatttacctatcatctaagcaatattaacatgtacaacaaagtagtaatatggtataaatagaaaataaacactccaagctgataattccataaggtctaatgattctattaaaacaaacacaaatcaaaattttccattttagggccccaaattcaacttgaaacattttttatatgataagattaaagcagctgcccaattttcaggaagctctgtctcaagttaaggaaaaaaagagaaaggaggaactatagttctttgggtgacttaaatcactgccttttttactttttttgccttaaaatcaagataaagttctcacctaaagattaacctctgaagacaatgaaaaataaccaggattggactttaaaaaacaacttaaaagtcagccccctcatacaaaactcgacaacaaataaacctagacttaactgtcattttcaaatccaatttttacctgaattggtaaaaatttatttaaaacaaaatgcaaaatacaatattgtttcaattttggcccaggagataaacactttaatgcagagttaataaactccagcgaataaataggatcattttcctaatttcacttcaaagctgccaggatttcaataaggaagttcaaaggcccgattccagaaactagaggtccccggaaagtgaggggcgtctggccacagcctcagttccaaaccaggtatagttcttgagctgtcattcttagtcctattaccactaatacaaggtcaaaaaaacggtcctgtaaggtgtcaattaaggggtcacttttgcctaaggtttccttaacttctctcctagtgaagccgctctaagtgaacatttccgctgtgttttttttaatgactgccattgtctcgctggagaatcggaggctcttttagaagtactgttggaaaattcaggattttacaaaacattttctcagctgtacagggcaaaaacaaactttaatcctactagccatgggtgtaaaccacaagcctaatttctcttctaagaagggaaagcttagttaagttttaaagtgacagtaattttaggtggtaaaatgagctcaactcaaacatcgctgtatgaaagcgctctccgccaacacgctcatggacacacacaactccttcctcgaggtttagggacagagagcgaacctgtgacttcgggccaggatgacgacctgagatttggacaagaggaggcggcggttccgcgaagagccaagggcggccggcgctccgggatgcgccggaccccgcggcgcatcctcgtttgggcgccaacgggcgccggcggtcctcggacccgggtgtcgactgccgtgtgcccactgccgtgtgcccaggccccgaagcctcctcaactccttgaggggcgcctccctagccagctcagcgcgcagcgggaccaaggctctcccagcttacctgcgggtccgagtaggaggacagaagcgccgcccggcctcgcccaagcgcacacgaaggggccgcttcccgccccccgcaccccagaccaggcggctcacggaacaccgcctcccagctctggcccgggaccaggcggtcccccagccggcttcggcgccgcggccggggacgcgcgtcttccttctccaggcgccggacgtggaacctgcgagcccctggcggcgccccaagttatgcacaggtcgcagctgctcaccaagctcctcctgggaggccgccctggtccccgagaggggcgcgcgggagtggacgttcccgcaccttcgccccatccacacctgccgccgccgccggggccgccagcgccgtggctccgccccggctccgcccctcgccgcccccggctcccgctccagccgccgccgcgaccgccgcggaaaggagggggagggaagaggcgcctggacggggctgcgggagcggccgtgctgagcctcctcccttgggcccggacgggacccaggtttctccactgcaacgcagctcccgagtgacggaattttgtgggggaagcggcggccactacgctcgcttttggcacagtagccctttgcgggtgggagcttctcgcagtcagagctaagggagagggagtccacctgcaagagccagagctcgcccttgtactctccgaatgcaaacttagcaaattgaacagcggaagtacttccttggtcggacccctgctcttctaggggtcttctagaaacgtggcggctatcacaggccccgtggtataactggcatttggaaaacgagggtgtttttccatctggagtggcctctctcctatcctcaaccctccgtgtccttcgacgcctctctcagatgccatctccaccaagaattttttccgggtacccacctgcgcccagatttgattccgccctctttgggacagcctgggtgctctgaacctttccactgccccttcaggtgtatgagagcgccttgtgaaatgcatgggccatcgttagttatttttattgcaatatgtggtttcatattcagtactgtagtatacaagcagagatatttatgctttcacaacacttttcatttgggtttgaattccttaaacatgaagactatagtaagttgcccatctctggaagtaaatactgaggggtacatggcagggtaatccgacccgatgacctagccagaagttctggctgtcctactcaactatgccctccgcaagcccagcatggtagcctttcacctggatttgaaggggaaaattgtatttctctctgaatgtaattacattttggcaaaggtcagtctagttaccaccaaaaaatattctacgagttgaagggtgggggtgggagcgtcagagcaaggttaatagtggtattttattgattttgaagtaaatataactctacgtagtcatttgttcaaccaaaacgaaaaatattcatcaaatattccctaataagttggtactcatttccttagccactttaaaaaacacaagtcaaatataattgattatataaattgtatttgcatgaagatttgagtccaaggactataagaaagattcaaattttaaattttctgcatacgatatggttaaataaaatgtttgtatactatttcctatacctaagtgtatgttttgagttgagatgtcagtagtgtttaatggttaatagtgttaagtaaacgacagctaggaatcactacagttagcttagaacaggttgaatttatgaactcccattttaaagaactgagaaatctcaaaccatatgactgccttgaccaagaaataaaaaaaattaaacagattcttaatattaaaatttctgaaaattttgaaaaatgaatttttaaaattaacagtcctagtatttttaaaaagcaaatattttagaaatcatgaaaaatgtaccttaagatgtaaaagaggataaacctcagagctaaggtctttttaaaaatgtagttagtgaaacctattcatggaaaactcaaaagcattctttgaagtgaaaaaagtactctaaatttattatggaaagtatagtatcattgaactcaaatagctattttaaacatcgtaattctgtgagtaacaagaaaaaaaagctttccttatatgtgaatcccactaggcaagactttgtccaaagtccaacagaaaaaaatattgaataaacaagcataagcatctcattcgtggaacatatttttaagcttttatacagaagcccaaaataatattatagaaaagattacacaattgcatagccaaaattatatatcataatattatgaatagcaaagaagcaaagaaggaataattcacctcaaatagcaaataaacaaaaagtgtcttaagcccatagtatcttttagacttcaactgaggcaagcaagctgtttggcccaagacaaatatacataatatcacagtaaacccagagctaatagaatacagccataagaggcccacattgcaaacacacaggcatctgtagctaaaactatcaaaggggcttgcccagggtacttcacatacaactttttgttccatcttacttcattataatgacagcatcatcttgaatgtgagaatttcctcctcaacctttacctgcaagtaaaagatgaaccactactcattttctagttgtaccctaaaatgaataaataagtcaaagtttctactggcatttaaattatttctaaatatattacttacaaagcttaatgtattattttagtgattaataatttctgtaccataaaacttgttctgtattagttatcacgtctttatacatccactggtaatcaaggactttcagaagagagtagaatacaatctttattttatttaaagtttaaatatatgtatttaagatacatatgtgtatgtgtgtgtatacatatgtatgtgtgtgtgtgtatatatatatatataaatataaatataaaatgcacccacacacatgaagtacaggacaaatgggaacagaaatgccaaaacaatctttttccaaaataaatatttataataattataaaataaattattaacagaaagtatacaaagtgtgctttccatttcatttttagtttacttatttagaaatgtttttgcatgtaagcaaacccaaattctggtgattattattagtattgtttttgaacaatgaggtggtgcaagaagcattggaaagaatttcttagcggtctctctggcattttttgaagttctaataagcttttatgtggaagttagcagataatttcagtttaagtgatttgactgatgacatcgacaaatattttaatgtcttctttatagtagacatgttatagaaaaactttatatataaaaagtttatatacagaaaacttgctaaaaagtattttatagttctttacgtagaaaaacttgctaaaaagacaacactataaatatctatgcaaatgttattatctgttcaaactagatggtgggtgtatgaatatctggcatcattttgaaatgtttcataattaagaataaaagttgaaataagaatatataacaacggtaaatgaaatattgaaattattttaaaaatatttgtgattccccatttatccttatataacctttagcacgttaaagcatttaaatggattatcttccatttgtagccttttttttttttgtagctacaatctcatgcctgctacttttgaataatacagttctcactgtgaagagcgaggtgagaaggaagcatttttggtacatgtagaaaggtgaaaattaatttttctaaaagagacagtgtcatgcttttcaaaataaatattgtaggtaaaacaggaacaagctgaaaatattacgtcattgtatctttattccatgctaagtttagaatgttattttgcctggtagtattattttctttaaacgtttagtcaaacacacattttatttcacctaacttctgtaaagtagaagtaggaaaagaaatatttaaattattgaaaaaactgaatatgaaaatatgagccatattctgttttattcctggtatgattttttataagaacatttagagaaagccatagttttcccttaaaaatgaaatgacatagtattggattgtacagttgtctttaggtatgcataaatttattgaatgctaaatcggtttccagaatttttcaaccttgcccattcagccctcattttaggaaccgtcatgaagcttgtcttaattgaaaatacaggcaacaacactagctgcttaaaaaaaaaaatccctcatgagctgttaacatacagaaagttaatctctggctcagaaataagtcttccttatcaatggccttgttcatctttgaatcatccatattttgaagaatcaaaggatttcagaggtctctatgaggaagagtggtggttctcaactccaacacactaggatgatatggatatatctacacgggcttccaaacaattattagattgttatagtacaatgcttagttcttgctaactctgattttatctctttctcctctcttgaaagaaagtgaaagcaatgttttttaacaactttaagtttgctctaatgtaaagagataaattattcatactcattatttgtaacccaccttacaatttatagagacgcacaacatgttaagtagatagaggactatataataccaaccccccatcactaatagttttattctaaggaaaaaagtcagtttactccctcttacctgtcaacctggtgatggcttcctcattgtgtgggtttaggctttagctgagtggtgagatggagtatggaaaggatctatctgacaggattctgggaggggctgctctaaagtgctttgtggtagagatatagaattggaactactactagggtcttactgctcagtaagactccatagaggatcagcatcagcaagaccatttaaaatgcaaaaccctagatgataccccagacctactaaatcagaatctgcattttaagaagagagagagagaaaggacttagagaaaacaaaaggtaaagaaaacattggtctttctcaaagatagcaggtcagctgctgaagagttctgaatagcaccctaaatcccagccatccattctttactcgaaattggacttattccttcaaggaatgcatttattagataaaaggagaaaagtaaataaatgatggactctgttttgacacattttgaacaatggccaggtacttccatcaggaaaagaaagtgctagggcatcctgcttaaagtaaaggactcttgtcattaagctagcacactaaattagaatgcaatagtgttattttagagtggtacaagacacgtgtcagtaatcctttttctggcattttagtgagtgcagtggaaaatgtattcaggctttggaatgaagtgcatctcatttttactctcctctctgacacttaccttcattaaatttccaaaatctttgtccctccatttgcataccagtaaaaatagtaaaaatattgtaatgtatagctcatatggtactgtaaaaattaaacaaaataatatttataaatttgttagcagagtgcagggcacaccatttatgtttaaaaggagagagacagagagagagagagagagagagagagagacttgagagaaacaccagttccatttcccttcctttgtaatggtgttgctgcacacctagtgtgttcagtatagaacacatcaaagaccgtcaaatgtctctgggctgttggttttaaggctgaaaaagccagcaatgtttggaaccacatcaaggattccaatccattcccactccccatccgatgaatgactagttaaaaagtcatgcccctgtgcatgttgaatacaagaaaaaacaagtttacagccaaggcatacttcttaaatccctgtccagctatggaaagagagctaaaatctaagcagatgtccaattgagacccaaattatgaacgtgtgcatgtgtgtgttttaaagaaaaaaatgcagattatctttatggccacgactcaccttccatgaaactatctgaaatgagaactggcagtcataagggagacatgttgatatatccaatacactgaggtagaaggcatttgtgtggctaggatatgtgagagggtccttttctccctgctgggttttttgtttgttttttgtaaatctcttgtgcctgatacttgcacagatatattcttacggtgagactttctccctggggaagttttcctagacatagccctcacccccatcctcccatgctcagttgctttgtctgctgttttcccatattaaaaaaacaaaacaagacaactctgtaatatcctttgcattgcatctcctctgctagcctttcagcggcaagtactatgctttatttttctttgttttgtcagcctgacccatttccaaacacatggcaggtcctcgataaatgcagaaatgaatactctgatccaacatttgcatttatcagacttggtatcccatatgaagtgttccatgaaaaaaaaaaaaagagagacagagagatgttcaagaaatcttgggcttaaacctcagacccattaataggctaacatgcattgtatttctcaaacatttttgaccatcaaaacccactcccacattttttagagtgtagcagggcacagtttgcaaaacacagccctagtacaaacaaaagcagtccaaacattcagcaatggttctttaatgctttctaaattacagagtgtaatagcattttgacaaaacagaaatctccgtgtaaccaaaagattcacaatactagatttttaacaacatttaattcaacggaatcccagtacaatgaaataatttggacactccctggtagtattttgtacgaggatttcacctgggttggataagaatctgactaatgttattttacccaaagtaagccaacacaaagggcaaaagaagggaaatatttggcataatatttttccaggcaatggtatcagcatagtaaactcagtaattacaactctggttctagacaggtaccctatacttttcaaaaagctttctgtagcattctgggaagatggtttggacaatggatagcaaatgagaaaagtgattgtatgaatcaaattcctgcaggtggtgatcttttataccaggttttcctcctgcttcttttctaccttccctacctctcctgccttccctgttttcacttctcctccttttatactcttcagaccactacttttcccccattttgttacatcagggctagtggataatgctaaactaacactcattatagtaaagatgatattaaaaatacatcacagctagaatggtacagatgctggtcacctagagctaaaggcagccagaactcttgagtgaggtctagaaacccctgatctgtcagaagctactgactcaaggaacaggagtgtcccaggtaaggggccaggaaagcaagaggggcactggagggtccgtggggcagtagctgtttatgcagaactatatcaataaagatatataacaatatatacagaacagtaccaatattttacatacctagtcatatcagtgcatgccagatgtatgtcacccttagattcaataactttttgttgaatccctcccatgtgcctggcattatactaggccctgaagacaggtcgaagagcaagatttttatcctagtatcaaataaattctctacattattgaacattaggtgatcaagaggtaaatcaagatgcagttgtgacttttttctgtttatctaacttaaacatcaaccctagtctgtaattaggttttaggcagtgggtaaaaaggaaaagtaagggaaagagaggttcaacttgggaatggaagcaaaagaaaacgttgctgaggacaaggaggagtgctgtgacatcattagaatgttttgactcctctttgtctttggaaggcattttcccactttcagaaccatctttgctaaacactctgttagcatgtttttattgaatgtttaattaacataaccttggaaatcatggggaaattgtttcctgaactcatcttcaatttaaaagatagaataataatacaggaaagtgtctttctttcctattcagggtattaaaaaataatgaatttgtatcctgtttgctttgaagtaacgaaaacagttattgcttatataaaacttggttatttgaaaatttattttcatcatttgaaatatactttgaaactcaacccacatcactctggaagatttcaaaaggaaaagctcatcactgagtttcttcttccaggcagggttcaagctccattcacatgtaaacctcacaaaaatgctttaagttggaatcataatctccattttaatgaggaaattgaggttcagctaaattaggtagctgacaaagatgacacatggcacatggcaaaatcagcacttgactccagctcataaggctctaagtcaaggaactactaagtcgatctttcccaacaaattaattgcatttccttaaagtctcttacatcaccatgtaaagtaccatctcacctaactgctcattgaaaaactcaggagaagaagaaaattcagattcgatacacaaaataaccagttttctatgtaactattaggttacaagccatcattcacctgagtgtgttttaaagttgaaacagaacctaatgtacagaaaacaaatgtcaaagcttctttaaaaggctagtataatccattatatattgtatttctaatatcaaaataaacttttattgcctaatgtgaattcaaagcaatcgagtctttttcgtccaaaacaatacaatatgcaaacttaacacaagactactttgtttgcttgttcaagtttctcttaagaatcagtactaaatttatagacatatgtatacactcataggttaaaaagtggactgtttgccaagcaggcttattctctttcctccccgacattgtttcttcagctttttcctcttccctgcacatcactttggacaatatccttaaatatgatgagagcttgacatgcggaaataaaagcaggatataaaaacagaaaatgaaaacttttatgagaacgaacaaagataaaaaagtgtgtgcatatataaatgtgttaatacacagtttgtatagcagtcataaagtatgcactctggcataaaaagatctaagaagataatgggagcaaatagtaggaacagcaagatgattgaaatgtataaaattacaaagggtagagatttgttctctgaatcctagaatccatgaaattataaagaacaacagaaaaagctatttgtgggtaaaatcaggaatgaatatacaagtgtgataataattataatatgtaaaatttaccagtttttaaagaataatttatgttaagtataatctaactcttctaaaatgccaaataccatagaggtgtcattttgacaattgaatattttggtaccctacatggacataagtgcttattaatgagttccagttaacagaatactgaataaatgcgcttttattgaacactatgcaaaccagcatttattgtggtttttaagatagatgggaagatgtttttctttgcacataaggttgtaaactcttgaaggcttaaacactgcagtaagtgcagcctggaaaatgagataaattgaaaagtaatttagtttaattcataaaatgagctatgatggaacctagagatatttgggggagatttctagctttaagaataacaacagaggaaacactaagagcagcaaagcacaaggctgatggtatccactagtttctaacatttcttattttcctgtaattaagctctcaagatttatgtatactaatgtgattatgtgtaaatacccatcatacttccaaaatattttaggagaaaactggatatacattcattaagttatatgcatttctagaggaataatttttctgtcttagtccatattaacatttgtgaagaaaaacgatgagagtttttggaatgaaatatatcttctaaccaaattagttttagttttagttttctcattttaaatgcatctaagcaataaaaatatgaaagcaattattgaatcataatgaaagtgttttttatttttaaaaaatatcttggaattaatatattaaagctttgctcaaactagattaaatcactggatttgatattagtccaccaactcttaacacattcttcacttgttaagatattgctctttctggcatttaagagaactgtagcttgctaaattaatatgacatcattctttttctccactggtgtacaaattctggttttctaagtgccttctcagaaatgcgttgttttcatactttggtttgtcagattattttaaacaaaatattttaagatacatttataatacaagttcaacattaaagaactttaagggggaattgcagaaaactggagatggaatgggcccaagcaggctatctaaaggccaaactcttgccaaaataagttacctctgtagagaacaatgtcattttcctctatttctttgtatatttaattttttaaaaaattatcgtgaattctaatagagctcacaagtgggatgtctttttcattttcttgtctgcttttcagattacttttagtaagtataatcaaaatattacttcacgtttattctttatgcatacattcttcctgtgtttttggagaaataaaccttttactgatacgatacgaaatgagcaaataagaggattgcttagcttttcaatgacaaagtaagagaatggaagaaaatccaagcagtggactgagaaatagaaaggcaagtctgtttaaatagtattgcgtttcaccttatgttgttcagtgtttatctctttaccactgctaatactcaagccaccctcccacctccaccaaaaaatatctggaatgtacaatatttacctttagaaaatcagaatttaaaagatagaaacaagcacaatactgccagtaacaaggggtgagattattctgtaggaacatgagaggtggtcaggaccagaggaatgaacttcgtttagagccatacataaagtaaaaggcaaaggagatgataataaaaagaaacatcattgaaagtggaatggaggagactaggagagtggtgttcaattggcagatcatatagaactccagagatgaaaacaattcattagtaattcattactcactaggtatctaatatgtatcctgccttctactaaacactggctaagaatacaaaaatgcaagctaggacctcacaataactttgcttctaggtggagaacacacttaactaggtaaacaatggtttatcgtattctcttttgtgttaaagatctgaagaataagaggagttgagtggagtgagctaagaagactggcaacctttgctagaaggttaggttcctactcggctttgcccccggacacctctctctgtcactggtgataatactcccttagcatttgggcccgtgtcatagcagaaagtgatttctctggaataactctgattttagaagatgatttcaaggacaaaaatcaatgtagcttacagcacaattagattgctagctgttaccaaattctctttgtaatttattttgtagcttctctctttattcactgtagcaggagaaaatacagagagagatgctttgaatataaaaatataccatggtaaaaaactatttgctaacaaatttggtttacttaactgtggaatcaagtcaggaaaattgaactgagagaaatcatagaaatgattttatctaaccttctcattttacagatgaggaaataaagtctaatgagatataacaacttatagtcacataactcatttctgataaaacccgatgtctacagactccatgttcttacctttacaccatactgtttctccttgcagtattttcctacttaaaatgacactttacatattaataacctacaaacttggaaatttcagattatgttatagtagaaagtgcttaagttggagctaatcagccctgaactggaatcctgttcagctcagctactaattagctatagaattttgacaagttgattattcattctcaacttgtacttatgatagcacttactatatctcagctacttttttaagtgctaggaaagtggcgaacaaaaacttacatttttgtaaagggacaatgacatacatgtacataaatatttactgtgtcaagtgtaatacatctgggaagaaaaagctggatgagcagtcagagaatgacaaagttttataaaaggtattatgaaaagtctccatgataataatagctaatatttttagagttctcagtatatcctaagtgctttacatataattgcctttaaatcctcacattatgctatgaagtaggtcctattaatatctcccctttaacagatgagaaaatgaatgcccttaggggttaagtaacttacccaagattatccagctagtaagcaatagagccagtagctctggctccagagtgtcctctaagcactatttgatgctgcttttctacttaaaatgggcagcagtggagcagagggttctctgagttgcagtttccctgcccataacaggctcatttgagaattgtaagatgaaatatacatttaaaacatagctctgcatctgtcacaaactaggttttataagtcagaattctttggctgcaatttacagaaacccaactgaagatatcctaataaaaatttttaaaaatgtattgtttcatgtaggcaaattgcatgggcaggagtagagtgaacatcagaagtaactaaggccaaggactcctcaaatgtagacttcctctctctctcttcatctctgtgtgttgactttattctttcctactacagaatgactttctccttgtgatggaaagtatggttgcagactgcaagtttatattctttcagattttaacagctaattaacgagccctcactgtagttaagagctttaccctgagtacctgtactcattctcaaaagtaatgctcacaacaactccatgcagttggtacatctgtcatgtccattttcagatgaggaaattgaggcacagacatgtaaatagtttatctaaagccaccaactagaaagggtcacaaatgtaggcagtctgttccagggatagtacccataagtcaacatattctgcttggtctgagttttaaaattaaatgaactaaattaaattaagggccaaaaacacagtttggatgttctagagacagaatttataccaccagctccagccagcccattcttgggaactaaaacctttgattgacaccctgtgggttctacttgacctgtctcatgttctctgtacatcctattttgcccactctagaactcttcagtctctgcatttgctttctctcttcattttttggtacctctgctggacccctgcttaatgaatgaatcatcctttctacctgtgaggctagtactgaaatcattttttctactcttgaagttagtgcttaaatcaggaattggatgaagcttcttatgtactatcagtcaatatgtataaaagaagtgaatagtgtaggtaaaaggaaccaatttcctaagatggaaggaaaggaagatggcacgtgacagtcctaaacctctaatgaaggcatctggggatggaagggaccagctaaatccagagttgggtcatttatttccagaaaatatttgaggcttgcacaattttagtctttctgcttccctcttgatgtcacttcatcttaaattgcgtttaatttttcatttgctgaaaatatggacagtagtacactttggtgaagtaattgtgcaacagcatgaccaacaaaggctcagaaatgagtgctgggaagaaagagaaataattgatttttataggaattctgcagaattggtggccatatgtataattggaaagctcccctttactttgtgatggctagacagttcaaatttagaattcttcattactcttccagtaaatctaatagtctataacactgagtttggttttcctcataaaataaactgtcaaaattattttatggcagtcataaatatgaatgcaataaatggaaaattttttaaattgatgaccaaatgtgtaatttaatacactctacctcttctaatgatgatcaataatatagactctcacatcttgttgtctgtgacacacccgtgaagcaaaaacagaccaggcaagtggctatccacgtgatagcatacaggctctgagttccttaggggtacaaatgttgtgttatccatttttgtattctcagtgatgatcatggtgcctatcacatagtagattgttcaatacagcttgttgaattacttgcttctgctgagatacagtaaggaaataagagagtaaggggaggatggtccaagttcaaagaaactgagttgatgaatgggtgaaaaggcaaggctagaaagtggtagaaaatgatacttgaggttcataggctaaagaggttaggagagctaagtaagccaaggtggcatttatggagtgcatgaaaacctttgcttagatgggacaaaaagattcctcctctgcagagcctggatagtggctgctgggttggagaagacccacgcaaaggggctggacactagcttaagacagtaagttgtttgttgggatgtttgttttcaccagccctaggcaggtggatttaaaataacttcatgaaaaggatcatatgacaacataaaaaagaatttggaaaaagaatgtatgaagtcactgatcccattctccattctcattactcctgtatactgatcagctgcaggatcagtctttagcctggagccagtccccatcatgataactatcatggtgatgttgatgacaatgatgatgacaatgataatgctgacaacagctaacacttattgagcacatatagtatgccagacactgttcaatgtcatttaattttcatattatttcatttaattttttcaaaaactctgtgagataaatactaatatttctattttacatagaagaacactacggcacaaagagattaacttgcccagggttgcacagctagtaagtggagaattttgggcattctgattaaagagcctatgattttaatcctcatgctatgatttttcatttaagctcagacccaggtggggtttaagagtagtgttggtgacttaagttgagttcccagactgcatgtggtaagtcctggacaggtacccatcccatttttctctgcttccaaatccatcccacatttgctttgtctgtagaagtaagttttctgaaatccctttcatcactatcatgcagaacttatttcaacaattgtaaaaaacaacaaacaaacaaaaaaaaactggtggaaaattggggacatatgggaaatctaaataccaactgggtatgacatgataaggaacttgttaattttcttaggagtgaatcgtatgtaagaaaatgtcttcaaattttagagatccatactaaagaatttaaaggctgaggtaatggtatctggaccttactttaaaacaactgagcaaagagatagtagccaaaggaaatacagtaaaattatcattattaaggctaggtgatcaatatgtggggctttattataatattctctctactttgaaatgtacttgaaatttttaataacaaagttaaaataaatgtaatattatgtgtttcctaattctgatactatcatacttgcccaattttgtgtgtgtgtgtgtgtgtgtgtgtgtgtgtgtgtgtgtgtgtaagacagggtcttgctttgttgcccaggctggagtacagtggtatgattactgctcactgaagccttgacctcccaggctccagcagtcctcctaattcagccttccaagtagctgggactacaggcacatggcacaatatcaggctaatttttgtaattttttgtagatttgtggtctccctatgttgcctaggctggtcccaaactcctgggcccaagcgatccgcccaccttggcctttcccaattcttacagcaaaaaagagtatacagttgatatgaaccattctctgaacatcatttgtttttactgtacctgcttctgtcataatgaacaagaagtgtgaaggatatttatctgtccatagcagcagatgacaatgttttatgctgaactacagcggacaggtgatgtgcaaatatatgaaactctcaaatatataactggctctgcttcttagaagcttgtagacttgaagtaagcaacctacccgctctaggctttttctgtgaaaagggctataattggatctacttccaggctattgttaggatttaggacataatgcatacaaatcactcggctcattgcctgaaacatagtgagaacccaataaacatcatagcacccaaaaaacataaataccttttagcagcagtcaaaaaaggtaaaacatttgtgttctacctcacaaggagtttccacactgtagctgggaaacaaatcaccccttaataaggttaagctatacagtatagctcagttttcatctttcacgtctcaaacagaaacatcatgtggatctttcactcaaaccaaatggaagttgttttcctttccacaacaatatgaattcccttggttagacagtaagaaggtcactggacaatttctgaactgtgaataagcaaatacaaagagaaggaaaaaagctgggtttgttgagcaggcattgctcattccagactgatgacacaacttttggttaaggatagtgaagatagagaaagcagttgcactgacatttcaacacattcctttagccatggtaattaacgcctcaacttctggattcagggaacggccctctctctgctgaggacattcatttcaaaggtgtgcttttaagtgaattgaaaaggaccctaaagagaaaggctgcctttcatatctcgtctctctcttcagtgaatctggacacagtgctttcatcttctcattgcccagcttaggtccccttttgttttgtggtgccctgttacgttgctttgttttggtttctctgggaggcctgccaaccctagcctcagagaaggctcgaaatgatgagatcaaatgttttgagacagtgttacatttcctttttttccccaagcttttctttgtttagctctatgcctcctgtcatcttaaatcttctcttccttatgtagtgcctctatagccaaagagattgctaagtcacagaatcacgtactttgaagtaatttcttgagagtaatgaaactcagctacctgacagaaaaatcccctttatgataactccaacccatgcttatgctcaaatatgacttgcacacacttcatacaggggagttccttgcaccaatactagtttttaaatgtagtttttagaacgttcttccttatggttttagaactgtaattaatcttaattctagttaatggagttaaacagaaggaatcatatcccctcctctcccacctgttttctctttttcagatttagaatctcattttctaaacattatgtagaaattaagatgtagaaggggagggtgatcataaaaatatacagacaggctttacagaattcattccttcattcaaaaaataattcaaagtacgagccaggggattctaagttttgaagtgaggagtaacttgatctatagaaggaattgaaacaaaaactgcatgaatagacttttgagtcagggagggtcttcccagatgaagctgggttttgtagacttagggacatttttccaaaaataataaaaaaacagggaggagttttaagcagcaatgtcatagggtttcaagacattttgccattatggctaccctcttctggacagactgtagttattcaccattctgtttcaggtgcacagcgctaaccataccatccagacaggggctggtgagtccacagtaggctgagccatcacctcctttgttctggacattagattgatgcatcctaatgatgtatttacttggatggtcactttgtcattctgttttgtatcagatagatctggtggtcgactaaaatcaatacctggtttgggttggatttttgatgctagatatgctatacagaagctggaccacaaaggaaactcacgtcaacttgagatgcccagcattaagtttctcttctctttctgcatctaattgagcctatatgatgagagttttgcttttgttctggtttttctcttttcttctataatttttttctaatgatgacagcaaacttggaaaatacagaaaaacaaagtgaagcaagtaaaaataattgaaataagcatagataaccattgttatcactgctattgacatctttcactaagtatcattttccatggttgaaatcatactgtcatgtagttttatatagcctgttttataactattattattaggtcacaagaatttattttccagcatattaaatggttttcatatgtgcttcttatttgaggacattgaatttcctggttttttactttataaaagaatattttcaaagaatacctttatatttaaatatttacttgcatttcagagtatttccttagattagcactctagaaacatatttaaagcttctttgatacatatttatacactgctttacaaaacttgttggctaatttacacttctacctgtattgtgcattaaaaaaataaaaataaaaaattaaccttgctgcttaattggagaaaatataactgcattattgtcttcacttttgtttttaattgttagtgatgttaaagattttacaatgtttattaagccatttatctttctttattgttaactgtcagttctcatctttcttatgcaggatggtcttactgattttcttctaaatttgtgtaatccttttgtatataaatattttaatcctcattttgtcataactcttataagtgagtatgcatcccaatctacttggaattttaatattgtttgtgatttttaaaaattacaaagaagccttaaaaatttagcttattttacatataccatttgagtgctactgtaatgaaaaataaagaggtttctttgcctgatttactttctctttcagtttgacctgagcttgaaaacaaaagtagaaaagaaaaaaagttttcatgggtttcgccttaaataaatcttacataattcctcttaaatgcattttctgtaataaaaagggcttataaatgtaattggaggtatgagttggggcctgcaaaggctgaattccaagacttgttttaatattgtgcatgtgtgtatgtgtgtgtgtgtgtgtgtgtgtgtgtgtgtgtgtgcattttgttaaatggagtctggagaggaaattaataagattcacataattctttcttctctggtgcttgataacttctcagccactgccaaataatgttaacttgttataacgtttgtttaaattctattcttaaacaaattctccttagcaaggactttgggaccaaacagtcctgaaccatctgtaaagtgggaataatcatgctctccttgaagtgcttttgtccagctaatcacaaagcaaaggtaaagtactgagctggtactggcacacagaagacacctaatgccagactctactccacctcaacctcctgtgtcaggccacgaaagactctgtggttcctgagaaataacatgtgttcaccagaatgcaagcaccctacactggtgttaacctcagtagcatgccagactgatatctgaatggaaaaaaacatataatgactgaatttttatattattcgtttatccaacaaacattctcaagaatcaaacgtatggctggtattgtgaaagacgctgatcatacagagaagattaaatctttcttcctgcattgataaagcagtactggaaccctttgagtaaacactcagaattatgtgtccatctaattttaccactaggtttagcttcgcctgctgtgcttctccaatactaaatttccctggaaacaaggaataatcacatttagcactgaggtatgggtgaaataaactctacaaatgtgctatgtaatgatccagtagattcagagaaaataacgtatttactgagccaacaaagtatagatacaagggttcttaaaacacaccatggtatcattaaatgatgaagaaatggtgtatgtatgatgctgatgaaatatttcaaaaaagaacattcaaataacaagagtaagccatttgttcctgaaggaattgctaattcagctttctcaaactaggcagattactgaccacttaactctgcaaaatatcccagtttcttgaagcaaaactgtttctaatactaagtaaaatgaacctttataaatttgctttaatgctcttataattcacattttttcttgtacagttgtattttatttttaaaatgtgtaattttaaagctttgcagaactgagaaatttgattttggagaaaagtggcaaaagagaaaattatctctcacttacttgatttgttttacttggtagaacatgaatttatattttgtgatctacaaaatgtcagttgccaaaaatggagctgagtcttttttaaaaaggtaattattttcataaactagacaaaaatcccaatttgaagagtacttgcaagagaaacaggtagttcttacttatctcaatttgtgcatgactaatctttcttcgggaccctccaggtcagattttagattgtttttgttaattatttccaaaagccgacctgactcaggcacattaaattatttccattggaggctctttattcctaaagaaaccaaccacttaaacatcgggtgagtgtttggagtttccaaattatggtaccactattcaattaaaaactacatcttaagtgaactatggaataccagttcacttttcttaccagcatggtttaccttgtcaggttcccctcttttctaacctggttgtgtacataactttctgcaagctatttggcatgtctgaatgggtggacaatcattggtaaaagccacctttccagtttacaagtctttcatatctagaagatcaaagagaatacaaaaattaaaaagagagaaaaagaaaagtacagaaaagaaaataaaggaagagaagaaagaaaagaagagacaaaattgaaacaaaaatgaagaaaagcaaaaagaaatcttagggtaatatagatgtcttttaatcaatgtgtatatttgtatattttctgaatcttttggaatgtcccctatcactgccccagtaaattaattttctctcaagacagggttgtaggaagtttaaaaacgaaacctagagagtgacagaaatcttgtcctggcttcttctgagcataggcaacgtaaggtattttattgctggatcattgttgttttacaagtaaaagccaaagtaaacacttgcacaaagaatctcatgaacgggccgggtgcggtggctcgtgcctgtaatcccagcactttgggaggccaaggcgggtggatcatctgagatcaggagttcgagaccagcctggccaacatggtgacaccccgtctctactaaaaatacaaaaattagtcgggcatggtagcaggcgcctgtaatcccagctactcgggaggctgaggcaggagaatcacttgaacccgggaggcggaggttgcagtgagccgagttcgcgctatttgcactccagcctgggggacaagagcgagacatcgtctcaaaaaaaaaaaaaaaaaaaaaaaaaaaaaaaaggatatcatgaacgatactgattaagtctttaaggcaataaccactcctgagattgtgcattgggacaggaatcataattttctgctcccaccctttccaatcactcacgtgcctcccaacatgcgcacgtatctggcggatcatacccttgtttcaaccttacaatgtgtacatagaagtgcttggtacaatcagaattctgctcagttacctggtgtggggggaaaaagccactggaaatgatctagaggagtgttatgaaatttgaagctgtcctaaagtgtagctgtaatttgattgacgtaaatatcttgcttgttacagtttattaaataccttttattttttacctttctccttttgttccctcagttttcagcttattctgaaaagtatcaaaaatattaccaactattactgcctttaattcacatcttctctccctgatgatttacaatttatgaccatggcaggtattttttttttttttttttttttttttttttttttttttttttttttgagagggagtctcgctctgtcgcccaggctggaatgcagtggcgcgatcttggctcactgcaagctacgcctccctggttcacgccattctcctgcctcggcctcccgagtagctgggactacaggcgcccgccaccatgcccggctaattttttgtatttttagtagagacggggtttcaccctgcatggcaggtatttttaagaaaaaagagtaaaaataaagtgacaaatagaaaagtcaaaaaatgttggagaaactaaattttaaaaactgaaagcattcactttatttaccttatatcactatagggattttttttaaaacagcatctcgctctgtcacccagactggaacgcagtggtgccatcaaggctcaatgtagccttgacctcccaggctcaagcaatcctcccacctcagcctcccgagtagctgggaccataggtgctcacctccatgcgtggctaattttttgtagagacaaggtgtccctatgttgcccaggatggtcttgaactcctggcctcaagctatcctcccctctcaccccctgacaaagtgtttccattcaggcatgagccactgcacctgggcccagggaaaattttcataatgttcagaggattgctttttgtatttttgttttgttttgttttgcttactggagggttataagaggtatctaagaataactttgagctaatgaattaaattttagttctttcttatcatgttattatacttcctatagttcaccaaataagccaggaatgcattttattactttatttgaaaattttaacaacttattagaaagcataaaaacagaaaatgaaacaaaagcagaatctccctgtgatagaattatactagaacacatgtgttttgtacatctttttgctgtcactagtttatattttcacatacattaatttatatttgccatgcattggactacatttccaactggacacatagtgacatctcccaaaccagtaatctaaagtttctcagatgagaatgcaaaatcaaatgtgttcatataaacttaaaaaccttctggcttggcctttattctctagatgctggagggaaagttcacatttgctctctgcaaccttgtctatgtttctgtttctgttgttcacacttctaatgtggggtggtgtgtgtgtgttatgtgtgttttcagttgctgctatcttaaaaaggatttcaaatgtgcatgatggagagagataacagtgtttaattaggggtaactataaagcagtcaccaacaattgtcagtgcagtttgaaaggttagtccttaccagagacatccttgattctggattttaaaaagagaaagcaatctacaaatgtaaataaaactgtgagtgtcataaaaacatgacaaaaccattaggaaatgttattctgtttcatttatttcttattcactttgaaaataactccactttgttttataatcataaggctttcttattcaacctgggttttctttctttaagtttctcccttcccttaagctatggtgtgccatggagcctcaagcaagaagacaaactctagagatgtaagataaaaagtgtagcttcttctgtgtacgtgcactggtacatttcaaaataaatgtttgaacaagtccacaaaatctgagccaacactgaataaagaaaaaaagaatgcatgcagaacaaaataatcaattgcacacacacacacacagacacactcggattcctggagtttctttggttgccttcctaccatgaaaattacgttggcattgttttctttgaaaccacatcacatcacagatcagatatttgtgatttcagatgttagcatttatacataagacattggattgagtacattttaaacataaacagtaggcaatgctgtacagagaacatctaaattgccttcctaattgtattaaataacagcatcaacaatgattgagccttaatagttcattgcaagtgagagttgatttctgtataaaatccaacaactgagagttgatttctgtataaaatccatagacatacttatgctgcagcagacagtataaaatagtggttaagaattcagaccctgaatttagactgcctgagttcaaatcctgactctgcacttggggccacctggccttgagcaagttgcttaacctctctttacttgttttctcatctgaaggacagcaatatcaatagtacctatttcataggattgttatgaggattaaatgagtgaatacatgcaagatgcttaaaactgtacctagtacatagagggattcaatgaatattaactgttgtttttatttaaacaagtcctacagtgctgaggaacttaaactgtatactgtttcttaggaaggaaataatggctgggtagtactacgtattttaattttctacttcactcctctcctaattgtcttcaagtctcagtctagcccaatttaggtccatagatcctgttatttagaaaaaaaaaattaaagactgttggctgaggacaaacttagctttatatagttggattctctatgttgtagccatcccagatctgatcttccattttcctgatctgcctggtgtggactttgttccttatttaatttttttttttttttagacagggtcttgctatgttgccaaggctgtctccaactcttggctccacagatccccctgcctcaacctccagagtagcaggaactacagatgcatgccaccatgcccaatgttctagtttttaacatgaagttttaaccacatacattgattagctatttggcaatccttcactttttgtctgctttttttgagtcctccgctttttgtctgccttgtctgtctgccaacataatgatttccagtttgttccaaccgttgtattcggcttccttgtatttagaactccagcccctctttatgcaaggaccttccatacctactttgtctacttcagccttgcttccacttcctccagctccatgctctgggctgatagggaaaagagaccttagaacacataggcttagtaacttaatcttcaaacacaatgagaggaactctttagttcataaaggctgcagaatgtagcagtgattcatacattttagtatacaacagaatcacttgaatgggtgacaagtgtgttttaagatgcagatttctggaactcttttctcagagattctgattgattaagtcttgaatggagctgataaatctgcattttaacccacttgctggatgattctgacatgggcagtccaagaagcataattcgagagacacttaacttgaccaattgaagttaagtgcccttgaatataccattgtctatattagtctcttctatgaactcccttcttgtattttggaaaacattgtgcatcaggccaactaatagtgcctaaaaattaatttagagtcaaaaggaggagctgtgtgaagatggcattttccccaacatcagaaatttttcatgactctggatccttacagcaaccagtcaggtggctagtggtttcgtttgtccatgtcttgcctttgaggagacagagaggagccaagactttctgaaaattactcttctacattattttttccagatttatctgtaacttacccctttagaatactatgcatccaaaaacatttaagagtaaaatgaaagtattctctaagctttgacttttgagtcaagtttttactccaacattgttgggtttttgttgttgctattgttgttttttcttatttaagcatccttacatctacatgtctgtgttcaagtctcatgtcaccaccaccaacttcaagccagaggctaataaagaaaaacccagccttattgactgagcaaggctgactaatgcataagtctaccttccctgggctcagtgtgccactgtagcccagccaaccctggcctattctggaagcagctcagacccagcctcatgcctgcatgacctgaatgcactgtcctcgacagaccccaaaacttctgtctgtgagggatttaaactatactggcatcactgaaacccattcttcctgcctggtttctctgttttgataggtcttgcatttcacaacacagtcacatgttgagtgtctgtaatttgctggagcctggctacatgctagaaaaggaaagacaaggtctctgccctccaggagttcatcagctcctcatgaagccagaaaaataaatggctacaatgcaatctgactcaccgtaactgaggatggatcaagtgaacagaagtgttctcctctactggcctataattaacagcgtccttggagcttctggggctcccaagatggaagtactgctgtcacccaaattctcttttctcatgattcaggatctggatcaccaatgctttctcagtgcctgatctaatggcagtatcttttatgttcttcctttaccattcactaaacttaaaaagcccttcaaagtcttccaccagtgggagacatttctccttcctttgaaattccctaatactttacctcatcatccctgtggtacttaccaaagtttaccttgtatcgtggctagtaaaatatatgctttctctctcgtccaggggacggtctggttccagagggcatggtctggactctacacagtgccttacacagagcactgtgcataattgatgaatcaacaaaggaaacaccttctggcagaagatcctgaacataaagtatcagagtttgccctgatctgaagcattatgtgttggttttagaaaatgcaatcttctatctctggccttgggaaaaaacaaaaacaaaaacaaaaaactccaaaattctgggatgattttagcagatccaaggagttttatccacacataatatgccaaaagacaaaaatcacatattctaattattccatgtttatattttagtaaattccctgtttaaaaaaacatggtgtgaaattctgaagcctaagttttgtagtttattgagaaaaatacacagtaacaatagtagcagtagaactgtttccaaaactgttaaagtgttttaccttgaccttgaagaccaagtgaaaaaatggattaaaaatattgaatatacaatatttacttgattggtaagacaattataaaataatgaaagggaagaaaattgagcatttatgtagaacacttcaccatttgcttgaccatgtgcttgactttgcaaattgcttttatgtggattatccatttaatacctatagacactgagtgacattggcattattaactctattttacagatcagaaactgggcctcagagagtctaactaacttggacaagattacttgtttagtgtgtggtaaagccagactacaaattcagttctatctaagtcccatcctttttaattacactagttgtacatcagagatttagctgagccaccaaatttccgaatcatagatatcttactttaatatatttttaatgtattctaagtaaaattaataacttatttaccctgcagaggtagtcttttagtggctacattattgttcaaagtttttatgtattataacatgcaggtttggaatgaaagtgcacaaatgcactgaatggccttggaactgtaatatgagagattagatttagaacctgggaaaatccgtgaagtaagttatcatcctacctaaaaacactaaagttatggtttggaaactttctagaaagagtgtgccaagctgctaatacctgtcttcctcataaggcgttggagttgatgggatggcaggagaaggcatttagattatttacttagtaattcctttttctaacatttggctcttttagttgtaaaatggaaaaaaaagaatagtatctacttcatgcagatgtaaaatgatatgatgcatataaagtgcttaccaaaatgtcagaatacatgaatgtctgaatacatgtcattaatttattaccttaaagcacagatattcattcaacaaatacctattgagcatctgaaagtgtcaggcaatattatatacaccataaatacaacaatggatgagataaacaagatcgttgatcaatgaaaatgttgacaacaaaaattttatttaagagtaattgtattgccattgcagtagcatctacagagtgcacattgttgccaagtacttgcccatcaattgcataagtaaaaattattatctccatttatggatgaagaaactaaggctcagaattaataaatgacttggccaaggctaaagagctactgactaagggattcaggatttaatatgtggctattagttccaaagcctatatttttctcactacacccaaaacattcttctagtcaggtccttagctcaggtatttccacctattattttctgtatttacagaatgagtttttaggggggcatagtgatatttgtagtggcctaagaagcctgcaattagttggggtaaagggaaaaatatagtatgcatgccacctctttctctccaattctttcattatttcacttaatcaacaaatattatttttcatgttccaggctctattttaggctctggggatataaagttgaacaagtcatagtccctatcctcatgaaacatacattctagtggggacatacatacaattgtctagtggggacaattgacagaaaagaaaaatgcataaaataattaaacactattaaaaatcttataaaggactcaaacagtgaactgatatataggataatgaaaggatattaacctgagagagcatggtcagaagatcctcactgagatggtaatatcaaagcccaggcctgaggttgagaatgagatagccacagggaggatggaagagagtgagttttgttacaggatgcagaaatgacatggtccaagaacccagtaagtctttggattccaggaaccaaaagaagctgacaagtatggccagaactgcagtgtaatatcctgagagacaattgttggtcctagtcagtttattggctcaagctcatcacgttcttatttcaagctcatctccctgttccaggaattaccatcccaatttttccagatgctgcccttcattcttccatttgagggtctcttctttcaaatattttgggaaacggggtatagaatttggactttggtcatgctttccattttcagatgtgtcaatcaggatcccaggagaaaatagaattcctctcagatgtttcaagcgaagtgattttaaagaaaggatcgtttatacagaaatagacatagttaaggaatccaacaagcaacactgggaaaccattccatcactaggcctatggtaacactggaacttaatgagaacggaagccatggaggaggggctgtttgactgaatctgtaatcaacggaggaaaggaactggaaacacagcgtcaaggtgagacaacagaaaacaccctctccttggtctcctcctggtatctcccattggctgaacccgagtggaagccaaagggcatgagagtgatacaatccacagaggtcagtcttctgggccccatgcagggccaagaaaagtggaaaatagttctaagggaagagagttaagtgacgaatgtccatcacagcactcctgtggcaggagcaccgacatcacagcaccaaagcagacagccagtagggaagaaatacccttatctctctcctttccctccaatatattgccggtacctcccactggctaaacccaactataaaccagcctaattacaactataaaacagcctagaagggagcctgtggggtgcagcttgcaagaatcaattttcagagacaaagagtagagcagagacaggtagcgaacagacaggagaaaaagctgaaagagaataaccagcagaatagaaaacagaaaactcatgcttcctacaaatatttattgctgctagctacaggtcaatataggaggtgaccatagttaatggaggggaaattccaaatttctaagaagacagagcaatcttaagtcataagaattatgaatatttgttagaatgaaaaaagaagtagagtgtgatctttcatggtttctcctatcttcatttttagatatgctcatgcctaatctctctattttcctctttcataagagatgaggcattggtctcttcaatggcccagtgcctagagataatgatgagtagtatttagcttgaagcatagactgaagtaggttatttgacatctcactggaagctggaggctgatcatttctagctccaccagttgctctatttacaaatatcttattttgaaaaatgtaggggagtcccacagggcagctataaggcaaagacatatttttcatatttcccagtttgccttgatttttagtggtgccaaataccctgtgtgcactaaaaatcatctttgatatttcttctttcacacctgagggaatttactgatgccagattgaactgacttgtaaggtagttaccaatgtttaattaagatctaatcatgccaagtcacagactgctatatcatgcatataaggatgacttaagacagggatatagtttggtatctcttgagttctgattaaatctaatactttaaattatgtataagatacatgggatctagatcatgctaatgtgagaacaaattaaagactggactaataaagtaagtacgactactcagaaaatgatcaaactctaaatggaagaacagtatagttgaaaacaataatctttgctctagttctggctctcctacctattcatgtcattgtggagaccttacttcactcacctgaatcgctactttcttaagttataatgatatgacctgagactcctattagccctatcatatcatgtctctctgagtacatgttatttattcaaataaataaggctgagagtttacaataacaatgctcaaacacatgagaaagtattgtaagaaggttgctgacttgttccattcccagaagaagaaaaagaaaagaggatgaaataaagggcggaaccaaatatttataagacatctgatatgtgtaagacactctgctattcccgctgtatacattagttctaatatcaactttacattaataattattattttcctttacttcatggataagaaaactaagactaaggaaattttgctattgttcacctttctttcattgttaatcttttttgaaagagtagtctacattcactttctctgttcactactcacttagttcttacttgcagtctggcttcaacgctcaccaagatgcaaaacttcttgtttaaccttttcaggattttttagagtttaacctgtgctctttcttgaaaccccctcttctgtttctgacacctgactttcctgatttaacttctattgtagcagctgtaatctttgcacaccatgtagcttaaacaaagatgaaatattatttcattccaaatgaacctagtgacttccatgctcactactggtaaaatacttaaatttatcaaatcaggatcaccgaggctattctagattaaaacacatttatctgatttttgccttatgcattctcatttccttctccccagactgatcaaaagctcagagggacttacttttgcttctcatataggagagaatgtctcggctggaatttacttttgatgacactcctgtttccctgttgtgcaagtgcaagatgattgctgttggaaactcagcggcctgcttctgctgactcactcctacctcagggtggctggcactgtgatcctttcaggcttagtcacatcctccttgcattcacggcttttgctggccaccctgtagtttctgcaaaaggctctcctggcctcattttattcttcagtaactggtcattttgaccaatcatcttttgtggtaaccccttgcaggaagactacctctcaactctcagctatttctaatgttttattagacacacaaaacatttttggatctcatacatctcaaggaaaaaattcaagagggctgggaggtaggtggagaaagtgtgaagaggctatctcaacccactctccgcctatatctgcccgcaaaatatgtcttctttcctctggctactccatgttggcaggagacccttgggaatgctatctctttccatagtttgaaaaaagaacatacaactccttggttttcagtctccaaacccatctggctatctccgtctcccaaccaggtttttactttgagatcagcactcacatcagcatctaatcatattgctattctctattcctctccagatttctccctcagccccccgcaaatacttctatctatggtgcaaatcttctcttgaatgatcatgaatcgtcacaaattccatagtttaaagaagaaaatgctgagtttaccagacccttagccttggtaggaggtggaaggaggccttaaaaaaaaaaaaagaaagaaaaagaaaaagctttctcattcaaagttgtctctatcactagcttttgagagcttcctttgaaacttgaacagaataatctgactgttttcatggtggatttcttcccttttattctttgtttcctgaacacattaagtcttcacatcagggtttacagttaactacatataaaaggaattggcaagaaggagaaatacaacacattggataatgtttcaaaatattatttttctagattggttgtggactccttttttctaatttattttcattctcccacactgtcaatgttggtgttaatcaagacattgtcaatgaacagcttctattcttcctattttatttttagtgtctaaatatagttttatatctgtaattcttcacttttttgaggtcatgtacccttttgagattctgtggaaatccagggactttcttccttcaaaaagacacttaagcatatacatatagttttcattattcgaaggggttcatggagtttcttaagcctattaataaaaccaagggggacataactacctgggtgaagaccacctgtccacattgttcattgctattttcccagagcctaaaagggcatcggccaaaaagcaggtattcagaattaattatttatttaaataaataaaacaattaatatctccaactctcatactgtcctgaattctagcccattttaccaactgctattcagatgtgacatcagaatcttaaactcaatacatccacactaaaagtattatctttttgttcccttttccatcagtggcctttgctttcctcagagttaagttattctgactttaccgtcagcatttttgcctcctgctcttctctaagtcctttaaattctattggctttcaaggcatgctgattatctctctcaatttttcacagtctgttgccatatatgaaggtggtactttgaggtgtctagccagctaaaaatggcacattaccttcaagccttcactcacaggatagttttcagggagtcaggtcttatccctcgccccatatctatagttcactggacacctgatctaagctaagccaatcacattctattggttagaaatttgatattgagattaaaaattctaatttactctagataattcctttaatatggaatataaaaaaactgtagagccctgagacatccacctgtaaccatgtggaattaataatagaaaaagcaaatatgccgatagaaaagaataaaacagttattcagagaaaagcaggagccagcaactgagaatccagagaagtattccaggttcctgacttctcagcaccaggttcctttctattcctaaagtctggctgtattcctgcccttggaagctataggatgcccctttttctccccattttgttttgtatgtggtaaaatacacataaaatttaccatcttacccatttttaagtacatagttcagtggattaaaatacattcataatgtggtgtatccatcaccaccatccatttttatattgttgtcgtctcatataactgaaactctatacccattaagcaatagctccccattttccctacccccagcccccagcaaccaccattctactttctgtctctataaatctgactacgctaagtacttcatataggtggaatcatagagtgtttgtctttttgtgattggcttatttcacttagcataatatgctccagtttatttattagaatttccttcctttttaaagctgaataatattctattgttgcatacatacatacatacatcacactttgtttatctgttcatcacttgaattgcttccacattttaccttttgtgaataatgctattattaacataaatgtgcaaatatctttttgagaccttgttttcaattcttttaggttgacccagaagtggaattgctaatatttttaattttgtgaggaaccaccatactgttttccacagtggctggaccatttcacgttcccataagaagtgtgcaagggttctaatttcttcacatctcaccgacactggttattttctctctctttctaaaaaatagtagccatcctaatgattgtgaagtatctcattatagttttaatttacatttcctaatgatcagtgatattgagcatcttttcatgtacttattggccattttatatcttctttgaagaaatgtctatataagtcctttgcccatttttgaattgcattctttgtttttagttgttgagttttaggagttctttaaatattatggatattagtcccttatcccttatcagatatatgatttgcaaacattttctctcatttcatgggttgcttttttatcctgttggcattgtcttttgatggtcaaaatttttaatttttatgcagtacaatttcttttctttattttgttgcctgtacctttggtgtcttacccaaacaagcattgccaaatccagtgttgcaaagattttgccttatgttttttcttttaagagttttatagttttaagtctttggttcattttgagttaatttttgcatatgctgtttgttaagtttctaacttcatctgttttatgtggacatcctgtttgcacagtactatttgttgaaaggactcacctttcccattgaatggcttgtgacatcttcgtcaaaaatcatttggccatatacacaagtgtttatttctgggttctctgttctatttcattggtatgtgtgtccatctttacaccagtatcacattgttttgattactatagctttgtagtaagtttcaaaattaggaaatgtgagttcaccagctttgttctttttcaaaatcatttttgctatatggagtaggacacttcctttttattcatatatccttttaagaaatactccctatttctttgtttgctttccctagcttgtggctttctgttatttgtgggcacaggtattaaaatggaatctgtcctggttccctttcagttaaagcaagataatagatgctatatttcatttttagcagttaagagatagacctgttatgcctgtaaacgattgacacagcttttaaactccgttactcacatgaggctacaaaagagctgaaaaggctatagaatagagaacaagagattatttatgagaggattttggggggagtgggaactctaatctttcaacattggagatattaatttgtaacactaagcctggggaaggaagcctcagtggaacctggctatgtgtttttttaaagggtgatctcattcatgagagaagtctgcagagcactgtgttgaggggagatcaagagcatacagacaaaaaagaggcactgctgtgtcaagagcatatggcctagttgcagctgaagcacaaattttgtgcttcaaaatttctggcaatcactggcctctcttattctccctctttttctcaacttaatatgttatgatcattgaaacaatgggctaggatatgaagacctggtttttgccagtgagtgggctccaccatctagccaagatatctttatgggagggcttgaggaagtgtgacactattctaatcttttgttaaaacaacccctggccagaagttagctgtatggtcacgccatctcaagtgaggctgagagtattgactttagctgggctgctgtttgatcagctcatactccagcgttttcaacaagtgtcttccagggttatcctggatgcaaatatctagttcgaagaaaaagaaagaggaccagtaaagaaagcacacctaattcttagtgaccttggtctactaatagaagtgagtagttacatgggtctatttagataaaagggaggctgaaacatgtagtcccttgccacgtagcctaaagagattctaagattctcaagaatagcctctgtcttctgtttaatgtttaggttaaaaataaaatcacagattacttaagaacctaaaattcttaaattggagggtcatccctgtaaaatgaagtgtctgagcttttgaaccacacagacttaggcttaagctccagctagcccactgctaaatacgtgtttttggtgcaaatgatttaatgactctcagcctcaatttgctcatctgtaaagtagaaatgggcatttggctggcatgagacaacaaatctaaaatgcttggtttcagcttgttttgccttattaaaaaggactttattccaccctgaccggatgtgctaggtgatcttacacaatgttgaagaatttattttcctatttcactctaccatattcattctataactggctccttgttctattatttcctcttacctgataatgaatctagtagttcattctgttcatttcattaaatccctttagtttaatgccaagtctatcttgctctcagggcacaataacttctcaatttatggcatctgggggctcctgtgaagccatcttgtatttaccactgtgttagttaggatcctggaaacagaaaccataccagtaaaaattactattcaggttatagtggcttaaagaaagggctttgccttgggaggagacagattataatacattctcctgggttctaattttctgcccagagtagaggaaacaactttttgaaaagaaaaatcatcttacaagcaagtagagcaaagccaatggcaagaaaaaaaaagggttggaagtttagtttgaagagactggctgttataagagggaatttagctttctgggggtgctagagacaatatctccgtagattttaaatggcattcctttagttcttggagcaattttggctctttacagaacaccacataagcatcgtttgctgtaccgactctatcttttttaaatttatgctctgccttgcttggtaactcatttgagaggtgctattggctgaaaatagcattgagtctgccctattcctgcctaatgggagtggacaggaagtgagtcctgagcagggaaggcggtagtgacagtgggagatttgtcctgctgttcacaaaacattagaaatatggtcctgcaagaattgcctgcagagacctctaaactatttgctgagtagcaacagtacttaaagtgtccagtagccatccaaagggttgccttttcatcaaaggggccacttcatacagatacatatgagaccatcaacttagagtgacagcaagttcatttacttattaattttattaattgtagaatggcctaaatgctcaacattcatccttcaaatttcactcaggaagctacccagaatcttctgactcagactacacccaccgagcaacatcttttgcagttttataaattattctactatctcttctacctgaataggagctcctggagaatgcagttttatatctgtagtgcctagcacataataaatgtttaataaatgtgagttaattgaattaagcagcctgctcattgtgaagcccagcacatgcagtgttagaaatgttttagtcatttgttttcccctagatttgcttactggaatcttaaatttagaggaacttgaaatggagaataaaaacaccacatctgaccaagaaacattatacatgattgttctgagaggcagagaggttaaacaaattacctaagttcatagatgtgaccaatggccaaggcagaactggaactaattctctcactcttcattcagtaatttcagaaattatgtagtaaattactttaaaactagaaagccctctctctgttagtgtttctgttggttgcctgtggcaactaaagtttcagtgggatttcatctcattttgggaattcatgagaccatcaccctaatctccagcactttgggaggctgaggcaggcatatcacgaggtcaggagttcaagaccagcctggccaacatagtgaaaccccatctctactaaaaatacaaaaattagcccagtgtggtggtgcctgcctgtagtcccagctactcaggaggctgaggcaggagaatcacttgaacccgggaggcggaggttgcagtaagccgagaccgcaccattgcactccagcctgggcgacggagagagactccatcttaaaaaaaaaaaaaaaaaaaaaaaaatccccattagatgttccaaaaacttcttccaaaggatcttccaacattcgttttctttttgtcaaaaccaattgaaaataaaatgtaaactaatgtcattgtatcctctcctttttggataattgtctctcaaaattagagtacaccgaccactgcctcaaagtattcaaacaaaatattaaaacatctttgtgatagagcttacaaatgagatatttgtttggcttttcctaagccgaagatggtttttatcaattttacaaagtaaagtcataaacatcatttaaaattgctgtatcagctatattaggatttgaattcttatacaaaggtgaaaaaagtgtttctatttccaagtattgttttccacagagcttcagcttagaaagaattcttttaaaagtagaaggtctgttcttaaaaagtagcacataaattacaaactttaaatagaattaacttatgacaaaattataataaccagtatctatctatattgaaggtttattattcaagcatggttcaaaatcatagctttgcttttaactcatttaatgtttataaccaccttataaagtagacgctactactgtgcctactttatataataataatagtacctagcacatctcacatcttctgagcaatggctttgtattatacaaaatactaaattaagcacttcatgtactttctattacttaatcctcatagtgtccatgaaagattagcaccatccttaagtgaacaaactgaagttctgcaaggttaattcattgccataaagccatagttagtaaatggtggaggtaagagacaaacccatttctatctaattcaaagcccatgctctgtccacaggcagcaacccctctgaagatgggaagaaatttgtaatttctttccaactcctgttaaaaaactcacagaacctctccctgcctactttactgctatctttagcctaaggttcataagttgattttgttaagtttagagatgatattaaaaatatttaagaactgcatggataccaactcatccgtgccactccagtggtcagtgcaactccagctttatttctatgttactggaccttagttgggcatgtggtgggaccaggaggaccagaataataggatgctactcatgagtctcagagaggtgcctgcctgtcaaccaccatggaaatattttaagtagtgatacttgtattaagaaatgagtatccagccaggcaccgtggctcatgcctgtaatcccagcagtttgggaggccgaggtgggcagatcacttgagcccaggagtttgagaccagcctgggcaacatagcgagaccccatctctactaaaagttaaaaaattagacaggtgtggtggcagccacctgtaatcccagctactcaggaggctgaggcattagaatggcttgaacctgggaggcaggggttgcagtgagccaagattgcaccattgcactgcagcctaggcaacgaagcaagcctctgtctcaaaaaagaaaaaaaaaaatgagtatccaataataacttcaaaagaaagaaaggaaggaaagaaagaaggaaggaaagaagggagggagggaaggagggagggagggaagggaggaaggacggaagctaagaaagaatgaatcttggccacatgaactaattgcaggaagaaactgagaagtagtatgacatgaagactaggagcttagtctctggaagcaagctgactggctcaaatcatagcttccttgttatgtgacgttgacaaattggcctctgtgctacagttttctcatctctaaaatgcgtgccataataatacttacctcgtatgcttgtagtgagtcctgagagagataacccaagttttcaaccagcaagagctttccactactgtaatatttacattcttaatatttcctcttggaaaagcctgtattttttttatctaatagtcttatagttaatgacaattcttcgcgagttacattaatggagggcagcaaagacatagatactccaaaacaacagataatgatgaagattattcttaatggcttttaaaaaatgctttctgagatgttttttcccttgcagattaatctccacttcaattcaccaaatgcgtattgaatgcccattgtggattggtcactgtgtcacaccaggggtacagaaattaataatatggaatccccgagcctgaggaaatcagtttaccgtgaaaacaaatgtgcaaacaatcctttacaatgggcttatataaagtgggtggagccatcatgttatggagtcatgtaaggttttacggataaggtacacattaccctcagtgagcaagaggggaagaaacatcccaggcagggaaacagcatgcaaaggaaggacaagaaggctggaaagagcatgatctgtttggggaacagacaggcgttcatgtggacacagtgaacggtgtacatgggagagtggaggaagtggaggctcaacacatatgaggaaccagactgagaaggacttgatttgccattgtaaggaacctggatataatcctgtagacaaaggacctcctcaggagtggtatgctcagccatgtgttgtagaaagatcacagtggcagtggcagcaggagacaggttgagtctgaagggatgacaggaagaaagttaacttttcctttatgatacacttttattggcactggatatgcattatccctttgcaatgtgataccagaaatgcaccaggtggcagagggcagctgggttgtaaaccatttaatgtgctgtggacagctagacctgtgcttctggaaggagcctctcacccgcagggtttgtgtccctaacttgtgctcccatgtcatttgtttttaacctctacaatgctcttagcaccctgaattgttcctttacatgtttatctgccactatgaacactggctctttgaggccaaggataatgccacttcctcaggccgcagtgaggctcatggagcacagccatgaagagaagacagcagtgtgacccacggtatctggggtaaactctccttggcatcctgtcatatttcggatagaacctcaacagggctcctctttggtcccaccaactcgtttcacttcacaactgccccaagctcttgcccgtcttggaacctgcccacatgctgtttcttcctctccttcctccacctaactctgaaagggagactccttctttttcttcatcctaaagtaaatatcacccatgaagggaggccattcctgatcatgattgtcctctgtgtaggttccctcgctcactccatgccttcagtcttcactgtgcctctttgctccttcatagaatgtgttgaaatctggagttataactccttttctttaatacactataattacttcgtgaaaattcataatatgtaatatttaaggctctgaaacattctgcagctaaaaaagttttaaactttgtttaaaaaacttgataaactgggtttagcaagcttattggaggacagaaatctctcccttatttgtgtatatttttggagaaatgaaagaaatgtagaaaagttttaaggataatataataaacacccatatttccactatccagaattaacaattgttaacattttgtcatagttgcttgctgccagtgttatataagaaattaaaagttgcagataaatataaatatctcttaattacaacccctgaggctcattcctctccccacttcccagaaactattaccaaaattagttttgagtgtgcacttccaaatatgtttttatacttttatatacatgtagtagtatccattactgtcaaacttttgtgcttttaaatttacataaataaatatataattttttagtcaacattatttttagatacatttatgaatgattttaactggtatagacagccataaaagtatgctatgatttgtttatctatttcttatctacaaatggacattaagtcagtcatcaagttttttgctaataaaaaatatgttgtaatgaacatatctctgtatagcctatagatcaagaatgttttcatttttgtttttaagacatgtacccaagtggaactgctgggtcatagcatggacacatttttaattctactgtatatttattaaattgcttttcagtgtggctttagcaatttaaatctgtgccagcaatgtgtgagagtagcatttgcccaatatctgtaccagcatctgctatctcatattctttattccaactaataggtgaaaatggtatctcattgtggttttaatttctatttccctagttatgtgtgaaattgaattatatacagaccctatctattttaagattttagctcctggagaaggctaagttggatagccgaactattcctggaattgtgccttgaataggcttctttcttccaggatatgatatactttgcacttgcccagtctttggcacagagaatgcattgattcatcttagctgagtgaattaataatgaaaatgtgatatgtaaatagggcaaggaacagttaacaagttacattaatgacttttacatttttacatttattatttatcatacatatttattataatatatccataactaatattactggggatacacatctttgaaaaatatgtcattgttacatttcttcaaactattattaaacactttttgaatactttcctttgtaggcaagttgatttttctagagtttgacaataatcaacatttaatattatttctcttgtgcacctatttagaaagccccttttttgcccaggaacagtacttcagcacctttttccatatagttgcaaattattaattaaggaaatattcctaatttagtctctaaattgagttcacagtgcttaacttagaaagacataaccacctatttttgttttccaaaatgttttattggtctccttttcaatttaaaaattacaaaactatttatgctcactgtaacaagtcaagtgctataggaggatattaacaactttattcatttaatccaaatatatttgttgaagtcccactgtattccaaacaatctgataaacaggtggatataacgaagtggataggtaggaaatagaaaaatcacattcattcattcaacaaacactgctatacatcaggcactaaattatgccctgaggataccaaaaagagtaagatatcatgcctgcttttcaggaatttgctgcctggtgaaaacataaagaccatacaacatgatctctactggaaagaatagaacacatggtctctctaaggattctagggaaattaggggattctttgctgggtaaggctgaggtaatttaggccaaagagccagcctagtgaaatgtttacacaactgagagtgggattatcaaggaagatgacacaggtggtagtcaaaaataaagtcaaaggtcagagccagagagcaaatctctctgagggatgtagtagaggtcagagactgggaaggcacagagctgggagagataagcttgagatacataacagtagtgagttcagccagaagttgtggccagtataagagtgaccaaggtctgtttttatgtggtgtcaactgtggaatatggaaccgggactggtcaattaaagaagcccagtaggaccacacagattgatgtcaagagcacatgaggtttgtttcataaagaatgagtagtaatctgccaggcagtcaaagtgaaggaggggcagaattggccaatgcattggatgcttcagagaacctggaggttcaagcaatggtgaaaggtaaggctccatcaaagggtaggtaggagcacatgtaatctgaggctgatggcagggcatggtgaggggtttagaggctatcacatggctttaagtgaggagagaacatgatttgagttttgtgtgaaaattgtacaggagaacactgaggaagataataaaacagccaaacaagaagagaagatggccagaaacaaggcaggatagagagaggagagggtgaggagttgagaaatatgtcaggatgcaggaaaaaaaaaacaaaaacacatgtcaactatttcctattcttttttttctgaaataaccaactgcagagaaaatgcaagaagaatggaattgaatatttcttactcacttttataaaatttcattatttttggagaatgtaactagagaattttaaaagtgcaataggagaagcatttttctttcagttgcagctgaaagcaagaagggtataatcacatgaaaataaaaacttagggcaaaggaaaatttcaagcctttaacagaggacgtatctgtcattgtttgctgatcaataaattattttctaacaaattggcattgatttttaataaggctataagcctgataactgtttgaacgtgtcttgtatattttatgttctactagagaagacatatgttggtatgttaatttattcatctactgatggataaataagtaaaatgatgaaataataaattccagctcttataaccagaatttcaagtcgtaacctggaagcattttcccactttacaaattatgatataaatatgatctaatgtcttcccttagaaatagaattttaaattgccttttaaggaatcattaattctatactatgttcctggcttcaataagaaaataacttccttaatctttctttccctgagtctcgactacttttctctctgatctgttccattttccacaaagttcttttaaaacatgaaatgcccacatgtgtgtttcttctttcccttcagcagctgaattttctgccacatatttacatgatctggtggccagctcatcagtccattcctctcatgtggaaatcactggagtgcaaaaccctctccgggtggcactgcactaattatttgtacgacatggctagaggagccatgcttgctccggattcattttgaacttatcaaggaaggatgtggatgacatcagaaaaggattttacaagactctgtctagactgccaaaacaatctgtggtgggagaaaattgcgtaaatatgggctaccaggaaacagtcatttttcttctcccctccttgtggtccttttttggtgtggaacagagtgcagcctgggctggcaattctgtaaattatactctttgaatcatgtaataataactcaaggaccagaatgatttaatgccatatggtaagtgaatgtgggaatcatctcagaccaaataaataaatagaagaagcaagtgactttgagctcgttttaacttacatgtctcttctaaatttcttagctttatccaagattttgtgggcattagctagacagacactacaaggctaaataataaatggacaagtgatgatccaggttttctcctttggatggaacacagggcccagaaccaacccatggatatctatgagagcctctttccctgtaccctaactactgagggtctggcagagcctcatattagctaaattgggggaaggaagtccaaaacggctaccatgtgccaaacaatgtgctgttttccgtaatgctaagatccaacccttaaaaagaataatttggtgagttttcatctttgagtttcctttttaatttttgaacccagaaatggtcacaaaaaatggaaatagatgcactccttgaagtgttaaacttgtactatgggtgacatttgtctctattttaaacaaaacttggaactcaagaaaaagattcagagttacatagaactgaatctaaaatcctaacaagcattgctttttcttcctgtttttcccttttctgggttcctattctatctttggcagcaattatctttcccctactcacagaccaccatatactttttaccaccatgctgttttagatcactcaaatctgttcaaaattggcctatttgggggcccatatttttcaaggactggttgagggttcctgaaaattcagactaaagtgtaaatgaccaattatgctacataacgaatcatttgaaaaattagtggcttaaagaaacaaccatttaaaaaagcattttatgattttctggtttggctagaacctgcatgattcctctactggcctcacctggggtttcttatgaggttatagtcagatggtatttgggctgcagatgggacttggtggttgataccttggcgctcctccacggctctctcttcctggcttctcatcttccaggacctctctctccatcagatgggcctagacttcgtacatggtggctcatagctccaacaggaaggaagtaaaatattccaggccttcttaatgcctggacttagaagtctcagcacattagtttctttgtaggcccagcctgaattcaagagacaaggacataagctctatctcttggtggatgggataacatgtgtgcacatggaaagaaagaattgtttgaggccaattttaaagagtaactaccacctaagcatcttcatattgggaaaagaaagaaaaaggagaaggaaggaaggaaagaaggaagggaggaagtgagggagggagggagggagggaggaaggaaggaaggaaggaaggaaggaaggaaggaaggaggaagggaaggaagggagggaaagaaaatgttcacagaagtcatgcattaagggagtctccactgctggatattttaggtaacatgactacgttgtaaaagagatgatttggagtatgcttttagctcaaattgtactgtgaggggacattttacatttgctggagtaaacctattctagttgtaccttcacatctctcctgcgagtcatgtaacctctaccttgcccatcggacacatttagtctcagccttaacatatggagaatcagagcagaccaactagcctggacacagcacagtcccctccaacacagtgcagaacctcagagaatctgtgaactgggtaggaggtagaaggtaagtaagcaagggcaatatttgtgtatgtaaaggcttagagacagaaaagcatgtggtatggatgggtaacagtgtgcagctgtggttaaaagggaactccgctttagaaatccaatgttccagtcaccattctgtcatttgctggcaatgtgacttatgacaaatcactgcagttcttgaacctctagtttcctcaaacgggtaatgaggaggtctgttgtatcaaaaatgaagggaggtgcatggttaaaattattttgttaactaaagtgctttgcaaatgcaaaattacaaaagcataagatgagaagtcatagaagataaactataaattttaaaaaactaaactatttttctagttcatgacagattaaaagaaaaataacaagaaacaagtgcagtgaagctgaaataaattaaaaagcacataaaccacatagatggcttataatgagtctattccatctaaaaacacactttacgttgctttacagttgaattcacacacctggtttaatctggaaattggtatacatcattttaaaagttttaattaactagttctatttgcaatgcaaataggtatatttgcatgtatttaattgtatttaaagcagagatgatttatcaagagcagaagttactccattatttaaagtcccacaggtgtttgcctttcacattctaggacaattagctgacttgcactaatttgggacttgtactaacgttacagttagtatgcataggacgtcatcgaaaacaaatgagtcacaggaaaaattgttttatatagagcgttaactcttgtcattaacttagatgatttgactctggctgtaagaccaaatgtagtgaggagcggagacagggaggacaaaagagaagaagctgcttcctcctgcctttagtacagggttcaaagggtatgtctgcacaaaatcctagggccagcactgacatatgagttttcacatgcatatggagtgagaagttgactgagcgtgtgcctgtagccctgagtgggttttcttttgcctccctgttgaaacataaaatactgcactcaccagtagagaatgactcatttatggagacccccttgaaacttaaggctccaagaacctgtgtgtagttttcaggaggaccaaaacaggtccagggcaaagcaagcttgatggagcacttgccagcagccaactgcacaggatttaagatggtacaactggtaataatagcactgagacagtggattcaggctgtgaggtggtcctagttttgatgaaattgacactgatattgatgtctctaagcacatggggatgtcaagatgactcagatatatatttaatggcctcctcttgcaatgtaatatttagaattccttccctttcatgtttgtaaatctgggagatattatcacctgaaaagctaagacaggctggttcaaaaaacctaaaagagcaagctctggggtttcaaaccttcttcctatgttctgtagttcaatctcattagactattccacactgctcaaacatccacattcttaaataactttgtgcgtctactaatttttttctgtaaattaaagttttataacttccactgtgataacttctctgattttttcatcagaattaattgtttttagtgtcagaggtgtgtgaaccagagcaagtccatcttcaataggggctgggtaaaatggggctgatacttactgggctgtattcccagacagttaaggcattctaagtcacaggatgagacaggaggttggcacaagatacaggttataaagactttgctgataaaacaggttgcagtaaaaaagccggctaaaacccaccaaaaacaagatggcaatgagagtgacctctggttgtcctcactgctgcactcccaccagcaccattgcagtttaccaatgccatggcaatgtcaggaagttatgctatatggtctaaaaagggaaggcatgaataatccactccttgtttagcatgtaatcaagaaataaccaaaaaatgggcaaccagcctcccttggcgctgctctgtctatgaagtagccattcttttattcctttactttcttaataaacttactttgtctttaccctgcagactcaccctaaattcttgtgtgagatccaagaaccctctcttggggtctggatccagacctctttctgtaacactagctctgggaagaatcctaacttaacactgtaagtatgctattcaatttaatctttataacaaccatataaagcaattctcataagctccattttacagataaggaagatgaggaagggttcaagagtttaagtaacttacccaaattcaaactgataataaatagtggtgacatgattataactcacacctatttgtgactcaggaactgattctctcctgacttactatgatgtgcctccatctaacccttatttcaatatctcacattatagtcatgtatgtgactgtttcttccataaattgcttaaaggaaggtattatttactctagatgcctgttgccactacaatgcattacatatgcaaattttaatgttcgttgtaataaaattaaatcaaattccttttctgccactttcaaccgagatatttttcagctgttgtaacctctaactctgattcttcttttttttttttttttttttgagatggagtttcactcttgttgcccaggctggagtgcaatggcatgatctcggctcaccacaacctccgcctcctgagttcaagcgattctcctgcctcagcctcccgagtagctgtgattacaggcatgcaccaccacacccagctgatttttttgtatttttagtagagacggggtttctccgttttggtcaggctagtctcgaactcccgacctctggtgatccgcccaccttggcctcccaaagtgctgggattacaggcgtgagccaccgcgcccggctaactctgattcttttggtagagatagggatactcattaatttagtcaccacatgaggggtgagtgaatcaatgctgatgctggtaaatttttcacttttatacttctgcaatgctgacaaggctgctgatgtatgacaaacatcttggctcagctcagatgaataaaaccaaattgtttgtacatgctaatgtaatagatggccctctttgctcttacagaaattgcagcttgattattaattataaatgccctaggactatgtgcttttggcaagctacaagttcttccttgtctaagtttttctttacttttcagaatgaaaaatgaagaaatgagccatatttgtatcaagggaagtacacagttacaaaccaagctatggttttgagaatttaattactattgctaatctgcttaaaagtgactaaaaccaaataagtggctcaaatttttgcttcatagattctttatagatgcaaaatacattgaccctccagaccaatacattttggccttaacactggagcagcaattggctttgctctagacctgtataattctcattttgcttgatctcctcaggagatcaatgtgcacatcagcacatttccccaactctcagttgccaaattagcatctccatctgccctgtctacacaagtttgtcggattattgaactcctgattggctacattctgacataagtgctttctttagataacaccttcccttccttgttattggtttttcttgggttctgtctttgaatttacctgttctttcaaaggactcagcaggctgcatggctgcaaagcaggtgcaagggctaaaaagactcagcaaattatactctaagagcaaagtccaaagagtcagaggggaaaaaaaggaagaattaagataattccaagagaggccactatggaagtgaactattgatctttctgtagagatgaagaacaatctgggaggtataaggagaagaaaattaaattgacagtcatctattttaagtggtccaaaccaaatgatcaaaccaaagcatttcattgagtttcttgaactaccactggttgttgcaaaaatgtattcaatgtcattaaaacaactcttatttgtctaattcaactgaattgttcaaccttcacttagtgtttcagcctagcaaaggaaatatgagaatgagcaaaatcctagttatttttacaggcttaattgcattcttacatttccaaatgacaattcaccctagaaagccccacccaattgaatttcctgctcttcatctatttttcacaagtttctctttctaaacttattctttcactcaccttttcctctccacatcttttcaaatttcaaagaggcagtggttggggcatagccaggtttgggcaataggcttagggcaggaaggtgtggttagggtggaggtggtaagaaggcattctagctcttttattttcgcatttcaggtcttggtaaaatgcagtctttgtatgtgtgggtgtttttctatgatgtgcaggtatgcacaactctattccctcaaatgagtaaccatgagtatgtcaatcttggaatagcctatgaatttatattacctacagaggaaactgtgcagtcagaggcaatttcacatggtgctcaactttccaaataatgcaaacaaccaaaattatttcacaaaaagaaattagggagattgatttttttcatttcatttttgagtgggaataatcatattctcagtaaggcatttatttgaaaatcatcactctgaatggataaataccttcataggcacaagccaaatttaattcagcattgttatggcaacatcaacataataaactattaatttattaacaaaaggcaataatttagttatatacagggagtttctgagaacatatgcccagaaatctttatagaaagatgttttgtgaacagtttatggctttggtgttaagtgtttagaaatgatgctctgtagccaggcacggtggctcacgcctgtaatcccagcactttgggaggccgaggcgggcggatcacctgaggtcaggagttcgagaccatcctggctaacacggtgaaacctcatctctactaaaaatacaaaacattagccgggcgttgtggcgggcgcctgtagtcccagctactcaggaggctgaggcaggagaatggcgtgaacccgggaggcggagcttgcagtgagccgagatcatgccactgcactccaacctgggtaacagagcgagacactgtctcaggaaaaaaaaaaaaaaaaaagaaatgatgctctgtagtcaaaaaatgttgaagcagaatgaagccttagagactacctggtactatctgtcactttacagaaagaaaatgggtagctcctaattgagtaactccaggtcattcccctcattagaagtagaggcagagaagcaggatccctcattctgcaccttccattaagccaaactgacttttcttttctttttttttttttttttttgagacagagtctggctctgtcacccaggctggagtgcagtggcgcaacctcagcttactgcaacatccgcctcaggagttcaagtgattctcctgcctcagcctccagagtagctgggattacaggcgcccaccaccacgcttggctaatttttgtgtttttagtagagaggcggtttcgtcatgctgccaggcctgtctcaaactcctgacttcaagtgatttgccccctcggcttcccaaagtgctgggatttcaggtgtgaaccactgctcccagccccacactgtcttttagggctccttttcaatctaggatgtcacaatcctgagcaaactctatcaggaccataagtgttgaaagaaataaaacattcttgagtttttaacattgtaaagactagtgtagatggcataaatgttcattgagaccttaagttcaatcaggtatagttatgctttgatattaatgtccatatatttgtctcctgccaaaataattattttatagttatagcaatttaagaaagtttcaatgcaatgtaaatagacatttaaaatatgtagagagcactctgattcccaaattcattatgaatgacacatgaacagtgtaagggaagcttaatttcacctttttttcttatttaagaactcacacaaatttcattacaaatagaaaagtcaatattaagttgaattttccatacaagtagatttgtaatggaaaaaggagataggcgcaacaaactaactccgtatgaaatttagaaggttggttggaaaagcccgtggctaattttcaggagaggatcaattccattctgattttagtgaatgatgtgtaattatccttttccttagatttcaattgaaaatttcttttcttctttagttcttaaatctgcctttagttatttgacacagtacatttgaagtaaacatgtaaagtatactcagggataaaaaatataaattattttccccatcataattctgtgaatttgtgttcatagatctgcataaattacatacctttctgaaattttctgatgcaatttaaaaaacaaccttcttttgagatacttctttttctgattgtttcttatccaattttcattttttctaatttttccaatgataggattctttcatatacatttttttctttgtagacacagggttttgctttgtcatcctggacaaagtgtcatcttggagtgtagtggcacaattatagctcactgcagcctcgaactcctgggctcaagtgatcctcccatctcagcctctagaatatatgtaactacaggtgctggccaccacacctggcttaatttttccaatgacatcagagaagagagaggaaaaacaggaagtgaaacagacagacagacttgggaatatacgtaaaggttattgtttttgttggtttgtttgtttgtcatcagtgttaacatcaaaattgataagccatatcgacagcatataccctttatgtgactagaatagtgctctacctctgtggtcttttttccaaaagcacataatccccacctaatcacaagaaaaccatcagccaaatctcagtgaaagaagttctacaaaatgcctgaccataatcctcaaaactgccaaggtcattgaaaattaagaaagtcagggaaacaggagcctatggaaagatgactattaaatgtaatgtggtatcctggatgggaatctggaacagaacaagaataccaggaaaaaaatgagaacaacttgataaaatgtggactttagttaataaaaattatcaacattggttcatgaattgtgacaaattatctcacattaccatactaatgtaagatcttaacaataggggaaattggatgtgagtatatgggaactctctgagctatctttcaataattctgttaatctgaaactgctccaaaatgtacagtttattttctataagaagcatattagcatccctgtatagaggaagaggagggggagggcattctagcagaagttacagcctatgcaaaggcatccacgatatcacctagcccatggctcctccccttccattttacctttgaaggaatctagacccagagtcctcaatattctattccttagctccccctattccaatgcaaatggaatcagtgaaagaacaatggagttgggagatggaaatctgggtttcagttctgtttctcccacttcctaaccataagaccttgagcaaagtgcttatagtctttaaacaggtttttgttttgttttgttttgctttttatagaactaacaactcctgcttaattagtgagactgttgcaaggatcaaaagagaaaacagatgtgaaaaaacaagtgaaagctgtgattattttcatttcccacatcctgattgctctatcaatccccctcccactcaaaccccagtgacaacttttagttacactcgttggctctgcaggctctgggaaggaaagcttatcttaagttcccagactaaaggcccatgtgccaggtagttggctgtttctttgttgattagcctcagagtgatgctgcaatgggtaaaatggtagcaggagcaatgaggaataatgagtttcatcctaggcgtcacttgttcgcacccgctagcctaggagatgattatactagagggatttgatgcaagcataggtcagaaaaacagagttcaaaacacacacaccatcttttgctgcatcagttagtatctctatatttcagttttctcatccaaaaaatgtggattatattttctactctacatacttcccataataccctaaatttattatagaaaataccacatattaaaattatcccctcaccagtgtctctaaaataagattacaatttccctcatatcataaagcagttcttgtttatagttatatactcagtatttggtatatattagatgttaaacaaatgactggtaaatttaaaattggaaattctatgtgtcagatttcatatccatgactaactccattacctcatataacctttggaatcactcgggggtggaggtagtggggtgaattaatatgctcattttacaactcaggttctgagaagtgaccaagtacaggcttccaccccaggccctggctcttgcaaatctgaatacccacgtctggaatgctctgctcccagacgtcatagcagttcactctctcacctcttacaagtttttacagaaatgtcactttctccttgagggcttctctaaccagtctatgtaaaatttcaaatcttattcttacccacaactccctctttcaaagcctgctttatttttgtctatagcaattattatactctgatttcctaatagcctacttttaaattttgtttacgatctgccttcccacttcccctttacatacacagagtcagaatgtaaccatcatcaggccaggaattttttcctgttttgtttacagatgaatccccaggacttagaagagtgcctggcacattgaatgaatgaatacatgcatgcatgagtgaatgaatgggcgtcgagacctgggctctatgttatattcagttctatcattttatatcaagagggttctgcacagtaaataagagatttttaaataaagtgatctcatatctttgttgggttttgttgatatgattgttttatttattttatttttatttttattttttttgagacagagtctcgctttgtcacccaggctggagtgcagtggcgcgatctcagctcactgcaagcaagctccgcctcccgggttcagccattctcctgcttcagcctccccagtagctgggactacaggcgcctgccaccacgcccggctaatttttttgtattttcagtagagacggagtttcactgtgttagccaggatggtctcgatctcctgaccttgtgatccgcccgcctcggcctcccaaagtgctaggattacaggagtgagccaccactcccggcctgttttatttatctttttaatgacacttagattcgtttgttagagattaggagtactacttggaattcaagaagctcttgtagcccctgaataaaattttatctgtcgaagctaagtcatggagaaggaattaaaacagaaccagagaagtttctttattacatctttaaagaaccacttgcttacaaaattccatttatgctaagaaaacacacacaggtacacacacatacacacaggatgagaatgatgggggcggaataattttaaatctcaaaagattaatgacagggaagtgggacctgaagtttcgaaggatgattaaaaaaagaattattttctacacaggtatttcttcttttgactgtattagctaaagaattttatttatttacttttgttctttttttttttttttgcaattttgttacatgcatagattgcatgttggtcaagccaggctttttagggtattcagcacctgaataacatacattgtacccattaactaatttcttattctgaacactcaacttgtgtttggtattctaaaataaaaataagtaagccttggagaaccaaataaattgttagctataaaagtatccttatgaaataatttatgttcctttttaatgacttttcactctaatatttcttagaagtgctcttgtaaatgtctaatgtatccacaggctgtcgtcttattggtcaaggcaaagtaacgactttgcctattttacgcttgtctgtagtacttcaaaattaccttttcatatccatgaacttgagtcaattctggaggattttaaagaatttggtgcatttaaatataccattcaattaaattgcttgagtttttgtttgtgtatctatgttcctgaaggtgattctatttaaattattaaattgctgtaacaaattttttaaaacttatacaaaagtgctttaggattacaggtggctcactgctgtaatcctagcactttgggaggccgaggcgggcggatcacgaggtcaggagatcgagactaattttctttaaattctaactttattcacacgagtctttcaagtgcagactgggaatgattgaagaaaagcttagtgcataggccagttgttctcattttaagaatcacacaggaatcctgtaaaaatggagattctttctgaagccatattagactataagctccgcaagagtaaggatttgtcgttttgttcactgcagtatcctcagcacctacagtacctggaacataacaggtactcaataaataatagtgaataaatgaatgaaaatctagtatgaagacatcatgggaacttgcacctttaaaattccctttagtgcttctgttgtagggggtcctcctgacccaatcacaactgagaaactttatattttctaattattcatcactgtacagatgtcatcactatagtgggattctttgctacttaatagttgtactactttcttgacttttcattccaaacatttttattgctagatataatatagagataacttaaatgtcagcttagaaaactattataaagcaaaaagctgtgtaaccattatccaggtcaagaaatagaaagttgccactttctagaatccccaccttgtgacccctcccttcataataccctctttttctcttaagagaatcacaaccatgactttgctgatactcgaattcttgcttttctttactcttttctcatctaaacatacatccctaagtacaatagtttagttttgttcatatataagtggaatcatacagtttatatttttgtgtctgactttttttactcaatgtatgtaagagcaattcatctaggttgctgtgaatgtctgtgtttattaattttttgctgtttgtagttccagtgtacagaagagttaatccaaatgaccttatcatcattactacaaggggaagtcagattgagtttccttaccttttcatcagcaagggagaatataaatataaatataggtgatttagatatatagataccatacaagcatggtatatatacatctgtactttaagagagcatacccggtaaagaagttgcatatatcaagtaacaatttcatcagtttgtgttaatcgaagtatataaacctgctactcagagcctccaagtgaattgagttgataaaggctctctgcctcttacacttcgggtcacagagcccagggagagtgtagagcctaatgaagagtgtgggctttagagtcaggctatctgggctggatcactgtctctttcattaccatctgtgtgccccagggctacttacttactcttcatgaatcttggttttcttgtgtataaaggagggattttaataatagttacttcataggattgttgcagtaattaaaaaaagatagtgtctgagcagcacttgattaatattgggtactcaccatgtgataggcctgtctctaaagacttctaacagccttatgtgtaattatttcatttaattctcccttaactgagagatccacaaaggaaatgttggaaatgcaaatatatgaaagaccaatacaacatgacgtctggatttctaagatgcaatacattttattctaattcttctgtgcatttaaaaatagcacagaataacccctaaaagtgagttctaaaaggtatttaaaggaatacttgtgaggaatgctattttttaatgtctttatttttaatgaacaatgactcatttcataaataaaattgtctctttctctagttgtttcctctgaacaaagaaggcttatgttataaagcagaattatgctagattaagagcttctttacctttttctggaaaactatatgttgtaagtctggaggaatatattaatgaggaaatgaacctcaaatgagagctatgataatatgaaaaagattttagttataataatgattgttaacactgattagttgctcatgtttgtatagtaacactaagcactgaagtaagtacatgtgatgagacgaggttttgagatagtaatttttgttttcctctgtatgtctctcttttctttcacctgatttaattagaaagtcaaagcagaaggagaaatgtgggtcaggggagtgaagggtctcagcaataaccagtgtgatcccacatcccctccctccttcccaaacaactggctattgtctgagagtctggaactgtgctatccaatacgttagccatgagccacatgtgctattgagcacaagaaatgtgactagtctgaattgcaatgtgctaagaatgtaaaatacataccagccttcaatgacttcatacaaaacaattaatgtaaaacacgtcattaatttttgatattgattatatgcttaattgatcatatttaaatatattgagttaaataaaatatatcatcaaaattaaattcatgtgttttttctaagtttttgaaatgtgtcttctagaaaatttaaagttacatatacaactcaccttatatatctattaagaacagtggtctagaacttggaacaaccctgagagtagaggggcaatctacaaagggctgaggttaatttacaaaacagccaggtggagtgggaggtctaaaaacaaattaaattgagttattaaaataaatatctacctctgacatgcctcagttttggggctgatatttataactgttgcacacagctgatcttatttaattttaccataacgctaagaaaatattatctctattttgaagttgaagaaaccaaaacttggtttagttagtgcactaaaccaaaatcacacagccaggtactagatcgaagccaggaagtctgcctctaagtccatagttttaagcaccatgcactactgtgactctagaatataatgcctgtataaaatgtttataaaaattggtacattgagcatatatgatatactctttcttcttcaaagaacaaataaaatttaacttctctaactcaatgcttgtccctaactctgaaagacagaatgagaagattcaaattctgcatccaaagaggtgtctaggtgctttcaggttccattcttagagcacagaaaataacctctatacaataatatatcattcttatgttatgtttgtatagttccccacagtttgcaaaactttgagatatatttatgtcatttatgtgacaaaactttcatataaattatttctttaatgaaacttgggaactgggaaaagctgaatgacttgcacagggtctaacaactcaccaggcttacgagtctcagactagctctcttgccattgcaccacattattttccgcaacacaccctgtagaaaattagcaaaatgagggcgtggatataatttaggaagctggagagtgaaagagagaaagagagggagagaaagagagagagagagagagagagagaaaggatttggggaactgaattaagagaagaggcaccatggaagaggagaacagatagatttgacagatagtagaaagcagagtgcacatgatttagtgccttataatttttgtgatgggtgattgtttgtcaacttggctgggacatgggatgctcagatacttggttaaacattatttctgagtgtgtttgtgaaagcgttctagataaattagcatttgagtccacagactgagcaaagcaatttgcccaacccagtatgggtgggcatcatccaatccaatgagggattaaatagagcaaaactgtggagaaagggagaattctctatccctgcctgtcttcaagctgagacattggttttctcctgaattcagacctgaacttataccatcagctctcctggttttcaggcctttggacgaggactggaactacaccactggctctcctggtctctagcctgttggtggctgattgtaggacttctcagcctctgtatctgtccattttcatgctgctgataaagacacacccaagactaggaagaaaaagaggtttaattggacttacagttccacatgactgagaaggcctcagaatcatggtaagaagcaaaaggcacttcttacatggttgtggcaagagaaaacaaagaagatgcaaaagcagaaacgcttgataaaaccatcagatcttgtgagaattaatcactaccatgagaaaagcatgggggaaactgcctccatgattgaaattatctcccaccaggtccctcccacaacacgtaggaattatgggagtaccactcaaatgagatttggctggggacacagagccaaaccatatcactctgcccctgtcccctccaaatctcatgtcctcacattttgaaaccaatcatgccttcccaaaagtcccccaaagccttaactcatttcagcattaacccaaaagttcacagtccaaaggctcatctgagacaaggcgactcccttcagccaatgagctggtaaaatcaaaggcaagctagttatttcctagatacaatgggggtacaggtattgggtaagtacagcctgttccaaatggaagaaattgaccaaaacaaaggggttatagggcccatgcaagtccgaaatccagcagggcagtcaaattttaaagctccaaaatgatccctttgactccgggtctcacatccaggtcatgctgatgcaagaggtgggttctcatggtcttgggcagctccacccctgtggctttgcagggtacagcctccctccaagctgctttcacaggctggtgttgagtgtctgtggcttttccaggcgaatggtgcaagttgtcgatggatctaccattctggcatctggaggaccgtggccctcttctcacagccccactagtcagtgccccaggagggactccgtgtgagggctctgaccccacacttcccttccacactgccctagcagaggcttaccatgagcaccctgcccctgcagcaagcttctctctgggtatccacgcatttccatacatcctctgaaatctagacggaggttcccaagcctcaattcttgacttctgtgcactgataggctcaacaccacatggaagctgccaacacttgaggcttgcaccatctggagtcatggccccagctctacattgggccctttcagccaacagctggagtggctgtgacacagggtaccaagttcctaggctgcacacagcacacagcaaggggaccctgggcctggcccatgaaatcattttctcctaggcctctgggcctgtgattggaggggctgctgtgaagtcctctcacatgccctgaagacgttttccccattatcttggggattaacattcggctcctcgttacttatgcaaatttctgcagtaagcttgaatttctcctcagaaaatgagtttttcttttctattgcattgtcaggctactctgcttcccttataaaactgaatgcctttaacagcacccaagtcatatcttgaatgctttgctgcttagaaatttcttccatcagatactctaaatcatctctctcaagtttaaagttccacaaatctctagggcaggggcaaaatgccaccagtctctttgctaaaatataacaagagtcacctttgccccagttcccaacaagttcctcatctccatctcagaccacctcagcctggaccttattgtccatatcattaccaggcttttcatcaaagccattccacaggtatctaggaagttccaaactctctcacattttcctgtctgttgagccctccaaactgttccaacctctgcctgttacccagttccaaagtcgcttccacattttcgagtatcttttcagcaacactccactctcctggtaccaatttactgtattagtccattttcacactgctgataaagacatacccaacactgggaagaaaaagaggcttaattggacttacagttccacacagctgggaggcctcagaatcatgacgtaaggcaaaaggcacttcttatatagtggtggcaggagaaaatgagaaagatacaaaagcggaaacccctgataaaaccatcagatctcatgagacttaatcactaccatgagaacaatatgggggaaacctccgccatgattcaaattatctcccaccagatccctccacgacacattggaattatgggagtaaaatttgagttgagatttgggtggagacacagagccaaaccatatcagcctccgtaatcatgtgaacaaattccttataataatcaataaattatcaacaattatctatctatctataactatggcacacacctgatctcatttaattttcactgtaaccctggatagatagatagatgatagatagatagatagatagatagatagatagatagatgtagaaagagaaatatggaagcccactggagaaaaaaaagtataaaaccctggatgggttgatatcagcaagagagctttgataaagagccaacattacaaggctttatcccttcccaattatgctaagaatacagtgggctttcagatgtaccaataagatatataatttatatatgtatttacataagtatttttatatagaccactttcttattaatatatttaatcatatgtctactgttaccatttctcaggagactcctcactaatataatgctggaggaaagggagaaggagaaggcaatgatgacgcccaggtctggcacctagaggtgttgccaagtgttagtcattgaacaataactgtactgaaaatgtaaaaaaaaaataactttccacctttcagattatgacagttttccattccacccccccaactttttagcaagcacaaattcatcaaagctatatatttttttcaaactcaaatacatgtatatttagttctttttctctgagtgggtttggcccttgatgtataattttcctccctatgttgagttgatgagactgaataactgaaggagttaagttttggtataagttgcttgttagctgtactgaacatttgagagagaaaaaacactataaaatcctggatgggtttatatcagcaagagtaagagtgtggagaggctgggtaaaaagcaaacattacaagactttatcccttccgttcccaattatgctgagaaaacaatgggcttccagatgtactgtggggaacaagataaccaaggttttctttaactcactacctccaagtcccattttcaaattgtgcacttgacttcatttaaaagatcaaatactaaagtcttgaaacacacacatacacactcacaaaaacacacatacatacatacacattataggtacttaagaaagaagtggctacttatgctgctgaaaggatcttggtgagctcttgactttcaaggaggtcatttatggttttcttttttccgtttttcttctgctaatggtttcctttaatgttatcttccctttgatgatttatctgtttgatagagactccaaagaaggtaacaaggaaaatgagatactaaaaatggttctcagctgacttaaaaaaagatttttaaggcagcaaattgtccatggcaaccatacacaacttacaagcattctaaggacccagaaacattttcatgacaggagctacgcaatattcaccagctcttcctgtgtcaatactgtctggtaggatggaattagtggaaattagaacatgcaccctgaataaatacagacccagttaagaaacacaggttatttataatacggcctaaattctattagaggttacatctccgagcctctagagatggaagtcaaaattaaaaaaaagggagttgcaaatttttaatagctatgaaactggtcttcaaacaaaatcttatactgatgtccaatacaaattgaaagctggaataggccccttaccaattctctttgtccattccagtgtcctgaaacaaattcatgggactataagactttcatagagaaagtctgaaagctgtttgaaaaccactccttcaggcaatgtatagaatgcgtcataaactcattcatggaaaatgatgcttgacattttgaagtgtttattatgagaatggtgataaatgcataagtttggcattctttacataatccatagcaatgtatgtggaagaaagcatttttaatagatactgtcatgtgtttagtttgtaaataaaatcttttaaaattattgcctatgacaactaattaagattttggtggattagtatctcatgagaaagttatttacaggcatccacttctagcaatatgacagacatgaatcctggaatcctccagatataaaacatctggggatgtggggtacaagaacacacacatacagacatatacacacatacttttaaatcaatgaaagataacggaagaggtaagaatcatctgaggctaagaacaaaacaaaacaaaccagtctatgaaggaaaatgattattgaaacttccacatcccttgagtacatgtatagaactctgtgaccaagaggtttcacacgtaaaagttcacaggaaggagggggctgtgttctaagtcttgggattgtacagactagatggccttagggtctaacccacataatgccaagctgagggagtgtacttatttgtaaaaatcaattgtaacattttcaggaattttgccagctgaatggcttcatactagtggctttaaataagccatagtgagagtatttactccacagaaacccacataggctataaagtagggcacccttttcttgtcagacagtaatttgctaaatatttacctgtacatcactggctactttaataagagaaagcatagtttaaatgaaatgaaaatcccacagagaagcaaacagaaaaaaaaaaaaatgtctgtcatgttctaagttctgggtagaggtgaaaaaaaggaaagaaaaccaaaaaccttcctctgagatttcaaagctacctttggctctcaaaatatttactcctgaaaacacagaatttgcatgggtaaaaaactttctaaggcaaaaatttttaagttaaattttaagttggaatctagagctgggaccccttccaccatgtgaggatacaatgagcatgcaccatctatgaacctggaagcaggccctcacaggacaccaaatctgccagcatcttggttttgggcttcccaacctccagaactcccttagagtcggaatattggttgttgtcaggcacagctttccgttgtgctgggaaacactcagatggcagaatgggtaattctacccattcctgcctctcatagccaaacaagccatgcctgctagagcttccaacccagcagtcctaattctgcctgaatttgctgaggggtgtgtccaggaaacagccagacagcagggcaggcaactcatccactcccacctctggtagccagacaggccacacctgctacagcttccagctcagtggtcccacttctgccttaactctgtgggcaggtgcaaccccattttcccccaggaagcactcagacagcagattcaggctgacccagcaaggatatgacctgtatgtcatctatggtccctgccagagagaacctatgaatcagaacaccccctaccccccaaaaaaggaacaacaacaacaacaaaaagaaacatgggcacagagctaaaagatgaaatagctattttacgaaagaactgaactgaattgttagaactgaaaaaactcacttcaagaacttcataatgcaatcacaagtattaacaacaaaagtgaccaagctgaggacaaaatctcagcactcaaagactgtctctgcaaaataacttcagtcagagaaaaataaagaagcataaagaaaacttcagagaaatatggtattatgtaaaaagaccaaatctatgactcactggcatccctgaaagacagggagagaaagcaagaaacttggaaaacacatctgaggatgccatttccccaacctaactagacaggataacattcaaatccaggaaatgcagagaactcatgcgtgatactatacaagatcatcatccccaatacacatactcatcagattctccaagaatgaaatgaaataaaaatgttaaaggcagctaaagagaagaggcaggtcacctacaaagggaaccccattaggctaacagtggaactttcaccagaaacattacaagccagaagagatttgagtcctatattcagcaatgttgaagaatagaaattccaaccaagaatttcatatccagccatactcagctttataagtgaaagagaaataagatcattttcacaaagcaaatgctgaggaaattcattaacaagagacctgccttataagaagtccttaagggagtactaaatatggaatggaaagaacattactggccaccacaaaaacacacttaagtacatagacattgacactataaaacaaccacatatcaagtctgcagaataagtagctaacaacccattgacaggatcaaactcacatatatcaacattaaccttgaatgtaaatgggctaaatgtcccaattaaaaggcacagttggataaagaagcaaggcccaactgcatgctgtctacaagggacccatctcaaattcaatggcactgtgactgttaatcttaggtgtcaatttggttggatcgatggatgcctaaatagctggtaaagtattgtttctgagtgtgtctgtgagggtgttaccagaggagactgacatttgagtcaatgggctgggaaaggaagacccaccctcaatgtgagtgggcaccgtccaatcagctgccaacatggctagaacaaggcaggcaaaagaaggagggataagctgacttgctgagtcttctgattttcatctgtctcctattctggatgattccttctgatcctcctgcctttggacatcagactcgaggttctttgacctttggattcttggacttatgccagtgatttgccaggggctgtcaggccttcagccacagactgaaggctgtactgtcagcttccctgcttttgaggcttttggactcagactgagccactactggcttctttcttctctagcttgcaaatggcctattatgggacttcgccttgtgattgtgtgagccaattctccctaataaactccctttcatatatacatataccctattagttctgctcctctggagaaccctgactaatacagacaccataagctggatccaaagaatggagaaaaatctactaagcaaataaaaacagaaaagagtaggggttgctattctaatttcatacaaaagagactttaaactaacaacaatcaaaaagacaaagaagggcattaaataatggtaaaatgttaaattcaacaagaagacctgactatcctaaatacacatacacccaacacaggagtacccaaattaataaagcaagttcttagagacctacaaagagacataggctcccaacaataatattgggagacttcaacactccactgacagtattagacagatcatagattcaggaaattaacaaagatactcaggacctaaacacaacattggaacaaatagatctgatagacctttacagtactcttcaccccaaaacacagaatatacattctcctcatctgcacatggcacatactgtaaaattgaccacacagttagccataaaacagtcctcagcaaactaaaacaaaatcataccaaatacacttttggaccacagtgcaataaaaatagaaatcaatactaagaaaaattactcaaaaccatatggttacattgaaattaacctgctcctgaattacttctggatgaacaatgaaattaaggcagaaatcaagaaattctttgaaactaatgagaacaaagactcaacataccagaatatctgagacacagttaaagcagtgttaagagagtttatagcactaaatgcccacatgaaacagttggaaagatctcaaattagcaacctaacatcatacgtagaggaactagagaaataggagcaaaccaaccacaaagctaatagaagataagaaataacaaaaataatagctgaactgaaggaaaatgagactcaaaaaaccatacaaaaaaccagcaaacgcagaagatggttatttgaaagaataaataagattgacaaccactagctagactaataaaaaagagagaagatcctaataaacgcaaacagaaatgacaaaggggacattaacactggcctcacagaaatataaacaattcttcagaggctactataaccacctctatgcacccaaactagaaaacctagaataaacagatacattcctggaaacatacaacctcctaagattaaaccaggaagaaactgaatccctgaacagaccaatcatgagttctgaaattgaatcagtaataaaaaacacaccaaacggaaaaggcccaggaccagatgaattcacagccaaatactaccaaatgtacaaagaagaggtggtaccatttctactgacactgtttcaaaaaactaaggaggtggaactcctccctaaatcattctatgaggccagcatcatcctgataccaaaacctggcagagaagcaataaaaaaagaaaacttcacgccaatatccttgatgaacacagaagcaaaaattgtcaacaaaatactaggaaactgaatccagcagcaaatcaaaaagctaatccaccacaatcaagtaggctttaatcctgggatgcaaggttggttcaacatatgcaaatcaataaatgattcaccacataaacagaactaaaaacaaaaaccacatgatcatcacaatagatgcagaaaaggctttcaatacaattgaacatcgcttcatgttaaaaaccctcaacaaactaggtattgaaggaacacacctcagaataatgagagccatatatggcagacccacagccaatatcattctgaatgggcaaaagctggaagcattccccttgataattggaacaaggtcaggatacccacactcatcactcctattcaacataatactgggagtcctagacagagcaatcaggcaagagaaagcaataaaaggcatccaaataagaagagaggaagtcaaattatctttgtttgcacacaatatgattatatacctagaaaaccccatagtctctgcccaaaagctcctagatctaatagaaaatttcatcgaagtttcaagatacaaaatcaatgttcaaacatcagtagcatttctatacaccaacatccaagttgggagccaaatcgagaatctgatctcattcacaatagccacaaaaagaattaaatacctaggaatacagctaactaggaagatgaaagttctctgcaacaaaaattacaaaacaccactcaaagaaatcagagataacacaaacaaatgggaaaacattccatgctcaaggataggaagaaacattattgttaaaatggccatacttcacaaagcaattttacagattatctatttctatcaaacgaccagtgacattcttcagataattagaaaaggctgttttaaaattcatatggaaccaaaaaagagctcgaatagccaagacaatcctaagcaaaaagaacaaagctggggccaggcacggtggctcatgcctgtaatcccagcactttgggaggccaagggaggcagatcacctgaggtcagaagttcgagaccagcctgatgaacctggtgaaaccctgtctctactaaaaactacaaaaattagctgggcgtggtggtgggtgcctgtaatcccagctactcaggaggctgaggcaggagaatcgtttgaatccaggaggtggaggttgcagtgagccgagatcatgccactgcaccccagcctgggcgacagagcaagactctgtctcaaaaaaaaaaaaaattaaattaaaaattaaaaaataaataaataaagttagaggcatcacattatgtgacttcaacctatactgcaaggctatactaaccaaaacagcattatactagtacaaaaacagacacataaacaaatggaacagaatacagagtccagaaataatactgcacacctacaaccatctgatccttgacaaagctgacaaaaataagcaatggggaaaggactctgtattcaataaatggtgttggaataacgtctagccatatgcacaagattaaagctgatgcttcccttttttacaccatatacaaaaatcaactcaagatgcattgaagacttaaatgtaaaacctaaaactataaaaaaaaaactctggaagataatctaggaaatactattctggacataggccctggcaaaatttcatgatgaagtagccaaaagcaatcgaaacaaaaataaaaattgacagatgggacctaattaaaccaaagagcttctgtacagcaaaagaaactatcaacagagtaaacagacaacatgcagaatgggagaaaatatttgcaaattatgtattcaacaaaggtctaatatcagaatctgtaagaaacataaacaaataaacaagcaaaaaccaaatgaccccattgaaaagtgggcaaaggacattaatgaatgctgttcaaaggaagacatacatgtggccaacaagcatataaaaaaatactcaacatcactaatcattagagaaatgcaaaccaaaccacaatgagataccatttcacaccatttagagggcttttattaaaaagtcaaaaaataagaaatgctggcaaggtttcaggcaaaagggaatgcttacacattgctggagggaatgtaaatttgttcagccattgtggaaatcgatctggcaatttctcaaagaactcaaaacagaattttcatttgatccagcaatcccattattgggtatatacccaaaggaatataaatcattctgccataaagtcacatgcacgagtgtgttcatcacagcagtattcacaatagcaaagatatgtaatcaacttaaatgcccaccagtgatagagtgcataaagaaaatgtagtatatatacaccatagaatattatacaactataaaaaagaatgtgattatgtcctttgtaggaatatggatggagctggaggccattaacctaagcaaactaatgcagaaacagaaaaccaaatactgtgtatactcacttaaaagtaggagctaaacactgagtacacatagacacaaagaagtgaacaacagactccggggcctacttgagggtggagggtgaaaggagggaggggaataaaaaaactacgtatcaagtactgggcttatgacttgggcagaaataatctgtaccaaacccctaagacacacaatttatctatgtgtcaaacccgcacatgtttccctgaacctaaaatacaagttaaaaaaaaaaaaaaaaaagagagaaggcccaggtatggtggctcatgcctgtaatcccagcactttgggaggccaatgtgggagaattgcctgagcccaggagtttgagactagcctgagcacatggcaaaatgctatctctatcaaaaattagctgaccatggtggcatatgcctatggttccagctactcaggagccggagttgggaggagcacttaagcctgggaagttgaggctgaagtgagccgtgatcatgacactgcactccaacctgggtgacagagcgagactctgtctcaaaaaaaaaaaagaaagaaagaaggaaagaaagaaagaaagaaagaaagaaagaaagaaagaaagaaagagagaaagaaagaaaggaaagagagagacagagagaaagaaagagagagagagggagggagggaggaaggaaggaaggaaggaaggaaggaaggaaggaagaaaggaaggaaggaaggaaagaatctagagctgggttggagaggtataaaatgagccaagaacatcttgttttgccagaaagcaaggaaatgatccaagaatgttgagaacatgtcaacatgacacagaaccagtttgaaaggccaaatctggcaaaatttgtgtcccatcaataccaagtgatattatttaccaatagaaaagaacaaataactaagacccacaaaaacatggtgaatctcaaataatcatggtaaatgaacaaaaggagatggtaaagactacataccataggattccacttatataaaatgctaggaaagatagaaacacattgattgttgccaggagtacatattgaggggcaacagaataactcctaatgggcactaggaaacttcagggtgatgaaattattctgtattatgattacggtggtggcttccctaataaagctgatgaaaaagaaaagaaagctgctattaatcttttaacatcaaagtagactttagggcaagaagcatgactgcacaaaaaatgggatatttcattaagatgaagaaatcaatctgccagggaaatgttagaattctaaagctatatgccccaaataatgtagcttcaccatacatataaagcaaaaattctgagaactggaaggagaaatagataattccacaatcatagagagaacaagtacagtttccatgcaaaaatctctaaagtaacaattaaaaacaaatttgatcgtgttgacatttctaaaccattacacccaaccactgcagagtacacattcttctcaagtgtatatggaatattaatcaaaatcaatcatattctaggtcaaagaacatgtctcaacaaattttaatgatttacagtatgttctctgaatatagtggaaataagctatgagaaatgttaaaaaaaaaaatagaaattccctaactacttgtgcaagaagaaagaatttatctggtcttttttctttggttccgctttcctgacacacagcttccaaaaccctcagaatctcctaataggagtgtcttttgttattcataactttttattattgtgtcactagtatacctgagtttctactagtggggtgactcatgaaaagcccttagatactgttgaggaagagtctggtcatgtcagaaaaaccaagcaactgattagaggattaaaactattgtctgttgaagaaattgagtatataatttaaaaccctcaaagaaaacaatctcccgatccaaatcacttcaccattcaatttttccaactatttaaaaactaatctcacaaatctaataaataaattaacctcgtagaaattattccagaaaacaagaaaaaagtaggttccatcctaagtaattttctgaagacaaaataacttcgatactgaaatctgacaaaaacattacaaaaaaagaaaattgcaaggtgatctctctcataagtatatgtgcaaaaatcctaaataaaatattagcgaatgaatccagtgataactgaataatgtctatcacattctagtgttgcagatatctcaaaatattgtttacattcattattgaaattaaagtagttatcagacatgccactatatattattcactgtactagtgatcaatacacatatgtatcactgattttttataaattttaataactgtattttgtagaacttgttttcattttaaataaaatgtgttcctttttaatcctgtgtattctgttttgtatagttcaaaacatacttctaagaagggtacattgacttcgctagactgtcacagtgattagtggcacaaaaaaggctaagatgtcctgttttagagtgatgcttataattgacctgttccacccacatgttcagagcttccaagcagatattatatatcctacttttaaaaatgagtagataatcaaggacccagagacacatgaagaaaacatcgcatataaaatacagtgattaaataagtaaatggcagagggagcggaggctcagtaacccagagaaacagagactatgcaggaagaagacaattaaaatgaaaacaatattttcaaacagataaagctattgcattcattaaattagaatggatcattacatttaaggtacattcagataatttcaaacacttttagaaattaaaattccaataagagaagtgaagaaatagaaaactgaaagataagggtgaagaaatctatcagaagatagtgttggagacaccagtatgaacttttgttagcttaatacagatataaatggttacacataaacacacacacacacacacacacacacacacatatatatatatatataaaatcagctaatatagtcacatatgtttttttgctctgtctgctgagaggtctagaaacaatggtaacccagtagtaacaaacttacctagtgtccagatttggtttctaacgcccattctccgataacaggatccagagatccttgtataaatggctggttctaggactgggataagaaatataaatgataatcctggagaattttgtagtgccagaaagtaaagaattacacacacacacacacacacacacacacacacacacacccctttctctctaacagagcacaggagccaaatgaatgagttcgcaatagcaaacaccagaccagtttcagcaacataataaagtagtattggattataacccaaagtataaaatatatgtccatgatatctaaatgattaaataaataaatgggggagaaggaactgatttcctttgctaagaattacaagtaagtcatgtgaatacaccccagcgaggagaagtgacataactccccactccttaagtgtgggctgtgcataatgacttccttccaaaaagcacactatggaaaggcggagaaaaaagtaacattatagtagagaaacctgacaaatactatcccagccaggtgatcaaggtcaatgtcaagaataataaatcatgttgctagaatgaagccttgatatggtatgatgagaatggcactttataatcttcctccctaaaactcataatccaagtctaattatgagaaaaacatcaaaccaattccaatagaggagcatcctacaaaatatttgactagcactcctgaaaactgttgaagtcataaaaaaacaaacaaacaaacaaacaaacaaaacaaaacaaaaaaaaccacaaggaaagtctgagaaactgtcacagccagtgggagcctatggagacatgatgactaaatgaatgtggtatctaggatgggaccctggaggagaaaaagtaaaaactaaggaatctgaataaactataaatttcagttaataatgatgaatcagtgttggttcattaattgtaacaaaagtaccatactaatgtaagaagttaacaatgggtgaacttgagtaaggaagcatatggaaactctacactatctttgaaattttctataaaccttaaactcttctagaaataaagtctattaaaaaaggtaagggataataaaaagattgtataaatgtaataaatatatggatattatatgacagcctttttattgaggagatgattatcaaaagcaaacaaatatacaaaaatagattttaagataaaatagattttaaggttgaagagaatcattaaagaggaccagtgtataataacaaaaacttcaaattaccaagaggatacaataattctatgcgcactaaaatatagcaccaaacacctaaagcaaaatttaaccaaagtaccaaacaaatgtatgaacccatcatcataaggggagatattaacttctttcagcaattgatatatcaagtagacaaaaatgtcagcaaggatataaaatatttgagcaacataactaataaacttggtctaatggatatttgtctgtatagagagagccttgtactcagtaatttgataattcattattttcaagcacacatgggattgaccacatatgtagccataaggcaagcaaaaatgagtttaaaaaattagtctcatatacagatcacttttctgacaccaacagaattcgacaagaaattaataacaaaatataatttaggtgcagagcggtttgattgttcgttgaaggagcacatttcctttgccgggcgactgcggcttctcccggggcagtacaagtggcctgactcaggggttgtgtgaaagagaatggtccgaaccaagccgactgctgggttccactggtgggagcccctccaccttcacctccgcaaacagctggccgctaaagctgccagaagagccccctctgccaatggggtgaagaatacgcgtcactgcagggccggacccttcgtcattaccagaaactgactgagcttctcatccagaaactgcctttccagaggatggtgaggaatcgcccaggatttcaaaacgacttgaggtttcagagcacagccattagtgcttttcaggaggctggtgaaacttagctggtgggtttgtttgaaggtgctaacgtgtgtgccatccatgctaagagattcaccattatgcccaaagacatccatccagttggctctctggaagaggcgagagaactgggagagagctctctctggggagagaccttaagtgaaggcagattttatggtattttgtaataaagtctgcaaaatactttgattaggtttagtctgtgactttttttttttttttttttttggctaagaaattgctttccatgctttgcatttgtactgaagtcactccatctttcactcaagacgaatgtgaaaagtgactgagtattcacagacctcaatgatgctcaggagtaatgagttgctaacatgcagaagagccagggaatattttgtgctcctcattatgcaagtttatgtatgttaatgacttgttgagtagctattaaggtaatagattgataaataaattacacaaggttattttgcaataaaactttatgacttgattcaagattttaacaatcaggactgttaaatctgaccatatatcactctgatagaatgtgggctttttccagggtgaagatacaagtcttaaccatagtgtaacttacagcttcaagaaaggaaggaagggaggaagggagggagggagggaggaagggagagagggagggacaggaagaaagaaagaaagaaagaaagaaagaaagaaagaaagaaagaaagaaagaaagaaagaaagaaagaaagaaaagaaagaaaaagaaaagaaagataagaaaggaaagaagaaagaaggaaggaaggaaggaaagaaagaaagagagacggagggagggagggaaggaaggaaggcatggaggacagaaagaagaaggaggaggaggagagcatttataatagccattttatgtattgtagtgtcaacagttttaaattaaatgttttacatttataagaggtatagtcattaatattgtcattaatatgtgtgtcatttggagtccagttgcctttctcctaactaaattatgcttgttttcacagtagtaaaatgctatgtggatatcataccttacataagtccttattctaccacatgttaactaacccctaactgataatacaaacactaactgggcgattgtatttataatggctctataagaaaatatgagccattcacaccagcatcaccttttatcaatattcttaactagttagtgcacgttttccttgtgtggtagtcagtctcataactaggatgagatttttctcccccactaagagaaaacaatgttgaagttattttctatgtggacttagtatgacaaaaaccctttgtgtaaattttctgtggagaaggagaacacagttccagctcattgaacctctgccaattaagatggtgtccagttaggttacatttggttaccatcctgagaaaatcacttttaagagatggccttccaaatggtttaaaaatttatccttccattaaagtttttaggttaattatgtatgtcgactaaatttatgaataaacttctttataaaaaaactatggcggccgggcgcggtggctcacacctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggtgtgaacccgggaggcggagcttgcagtgagccgagatcccgccactgcactccagcctgggcgacagagcgagactccgtctcaaaaaaaaaaaaaaaaaaaaaaaactatggcttcatgtctaaaaattaaaaaaaactttaaaacaacgtgtcaaagaagaaatcataagataaatatacatatcaaaagttatgggatacagctaaagcagtactaaaagaaaaatgtgtaactccaaatatatttattgagaaaaaaacgaaataactatgaactaaatatacaattgaaaatgttagaaaacaaaataaaatgaaagaaagaaacgacatgaaataatcttaaaaggacagaaattaactgggaaataaagctaaaatagagaggactgacaaaatcaaaactttattagaaaagatttatatcattgacaaaatgttgttaataccaattaaaaaataaaaatgtagagcaaaacatattaaatattaaaaatagatataattactaacacaaaggactaggaggataaaaaatttccaggaacaagtttatgccaagaaatttgaaaatttagattaaaaaactgaactcatgaaggggttgcagatgatatgaccttatatttggcaaaacctaaagactccaccaaaaaatgattagaactgataaacaaatacagtaaagttgcaggatccaaaatcaacattaaaaaaaatcagtagcatttctatgtgccaacaatgaacaacctgaaaaagaaataaaaagtaatacctaggaattaacttaacaaaaaaaatgaaagatctgtgtaataaaaactataaaacacttatgaaagaaattgaagatgacacacaaaaaaatcaaaaggtattccatgttcatggattggaagactcaatattgtcaaagtgttcatactaccccaagcaatgtacagattcaatgaaagtcctatcgaaagaccaggtacattcttgaataaatagaaaaaacaacccttaaatttatatgaaatcacaaaagacccagaatagccaaaactatcctatgcaaaaataacaaaactggagcaattgtattatctgacttcaaattatactacaaaacttttgtaacccaaacagcatggtactggcataaaaagacacagagactagtggcacagaatagagaactcggaaacaaatccacacacctacagtaaactcattttcaacagtttccaacagcatacattgggaaaaagacagtttcttcaacaaatggtgctgggaaattggattccatatgcagagcaaggaaactaaacccctatctctcaccatatacaaaaatcaaatcaaaatggatgaaagagttaaacctaaaacctcaaactatgaacttactataaaaaacattggggaaactctccaggacattggttggggtaaaaatttcttgagtaatatcccacaagcacaggcaaccaaagcaaaaatggacaaatgggatcacatcaagttaaaaagtttctgtacagcaaaaacaaaaacaaaatatgcacaaagtgtagagacaacccacagaatgagagaaaatatttgcaaactacccatctgacaaggcattaatagctagaatatagagggagatcgaacaactctataggaaaaaaattaacagtctgattttaaaatgggcaaaagatttgaatagacatttctcaaaagaagacatacaaatggcaaacaggcatattaaaaagtactcaacatcactgatcatcagagaaatgcaaatcaaaactacaattagcatcatctcaccccagttaaaatggcttatatgcaaaagtgagccaataacaaatgctggcaaggatgtggagaaaaggaaaccctcgtacactgttgatgggactgtaaattagtacaaccattgtagataaaagttggagtttcctcaaaaaaactaaaaatagagctaccatatgattcagcaatctcactgctgggtacatatccaaaagaaaggaaaccagtatatcgacaagatattgacactcctatgtttgttgcagcactgtttgtagtagctaaaatttggaagcaacttaagtgtccatcaacagatgaatggataaagaaaaaaacatgttgcttgcagcaacataaatggaactggaggtcattatgttaagtgaaataaaccagtcacagaaagacaaacattgcatgttctcacttatttgtggaatctaagaatcaaagcaattgaatttatggtcacagagagtagaaagatggctatcagaggttgagatgagtcgtaggggcaggggtgaggtggggatggttaatgggtacaaaaaatagaataaataacacctgatatttgatagcacaacagggggactatagtcaataataatttaattatacattttaaaatagcaacaatgatataattggatgattttgtaacaaaaagatacatgcttgaggggatggataccaaattttctatgattatgatgtggttattattcattgcatgcctgtatcaaaatatctcatttacctcataaatatatacatctactatgtacccacaaaattaaaaatagaaaaattaaaagataaaaaagaagagaaaaatacatttaaacaaattattaaaggaattgaattcatattttaaaatatttccatgaagaaagcaccaggtctgaatgattttaagttagttttaccaaacattcaagaaatagataatcccaattgtataaaagtttttacagagaatcaaaaaagaaggaataattcccaattcattcaatgagtttagtagaacttaattactaagctggaaaggacagtatgagaaaggataattaaaagtaagtctcacccttgaacacagattttttttaaagttaaacaaaatcagcaaatttaataaagcattatactaaaaggatgctacttcatggctaaagattatctatcctaagaatccaaagttgtcttaacattagacagacagtagaaaggagataggttaaacctctgttatacttactctttatactgggagtaataattgaaaatgggttctccatgacagagaatcatgggaacagtgaaaattcctttataataccattaaacccccctgagaaactggtactttcacacattgtaatatctttatatgtatctggtttgagggataaaaatatatttctccatattccctaatcaaaagcatatttctcaatagaattccaacatctattaaccatcactagaggctacctgtatttttaatacttcattttattttttaaattgacacttaataattatatgtatttatgggatacatagtgatgttttgatacatataatgtataaggatcaccttgatttaaggggaccatttccaggagcctccagaaagagctattaatttgtgagtacataccactttgatagatggcttttcccatgaccactagctgagacctatattctgatggaatatgacataggaatataagtttcagtggaaaaataacaaaaagaatttcagaaaatagagaacttcagagtacgaaaatatttatcccagaaccacgtgtgatccatcactgttgcactggccccttcctcagctcacacctattgtcactggtgggcatatgccttggttagctcaagtatctgaaagtttatagagtatttggtccagatattgaatcctgaacataacatcagatcaagaagcgcactttttggtaaaggaggtgtcgtggtgggcatgtgatcatgggacccatcggctcctctcacatctgcaccacccagaagcagctggcctgatagaacacaggactgtcctatagaaggcacagctgaggctccagcttagagatgatacccttcaaggaagcggcagcatccttcagggtgtagtatattctccaaatcaataccctgtacatggtgctgttaaatccacaagaggtaaaatgaagatgtggaagtagcaggagtcctacttatcgtcattccctgtgacccactaggggaaattgtgcagctgcaaggattgtaggttgccccactaacattcctcagttttgccttcaaaacggattgaagaaatcctggaggggctgttcccaggtaggacaaacttactatacaaagcaagtagaccatccagtgcaaaggaccacccagtatagaggatggatgctgtgatgcactgcacagatttctccctttattaccgaatcactcattcccccagctgccaacagcacaaagctatgttcctacctaggagctacctcattcaaagggagctgccttgcccaaggctttttccccttcctagatacaccatgcatcacatggctgactgatcatgttgggtacaaaggcctggccctcttacatcaactctcaagaacaacccccaccccaaagaggttttttttgtgtgacccaattgcagttcagctaccctctgaccaatcctgccgctttaatttctcccaggtgtttttatccagagcactctttataaacttcctgcactcaaatctttcttgccagaatgcagacagctcaagtattcttctactgtttggtggagataattgagatgtttgaatatgtaagacaaaacagaaaaaagtatccacataagcaaaccttccttattgacttactttaatcagtatcttagataaacatatgaaattttgagttatcattctttcagtctttcattcattcaaaagatatttctttatcatctataatgtgtagaactatttcagattataggaatgcagagatgattaaaacacagtctctgaccgtaagaagcttacaattaaatggggaaagagacatatataggggaacttaagtatatgaaaacaggctcaacatagaacaaacagtatagatgtcaaatgtgaaaattaatgaatttattaattaatttattcttctacatccatttttgcctttattgaaagtagtgaatacatatcagtggccgggcgcggtggctcacgcctgtaatcccagcactttgggaggccaaggcaggctgatcacgaggtcaggagatcgagatcatcttggctaacagggtgaaaccctgtgtctactaaaaaaaaaaaaaaaagtacaaaaaaaaaaattagccaggcgtggtggcaggcgcctgtagtcccagctgcgtgaactcggggaggcggagcttgcagtgagccgagatcgcgccactgcactccagcctgggcacagagtgagattccatctcaaaaaaaaaaaaaaaaaaaaaagaaaagaaagtagtgaatacacatcagatagattaaaatccatttcaatgctaatttctgcatgctctggttctgttggagagaatacaaagatattctaattttcataatttttttaaattttttttttatactctaagttctgggatacatgtgccaaacgtgcaggtttgttacataggtatacatgtgccatgatggtttgtatcaaccatcaacccatcatctacattaggtatttctcctaatactatccctcacctatccccccaccccctgacaggccctagtgtgtgatattcccctccctgtgtccatttgttcaactcccatttatgagtaagaacattcagtgttcggttttctgttcttgtattagtttgctgagaatgatggtttccaccttcatccatgttcctgcagaggacatgaactcatccttctttatggctgtatagtattccagggtgtatatgtgtcacattttctttatccagtctatcattgatgggcatttaggttggttccaagtctttgctattgtgaacagtgctgcaataaacatacgtgggcatgtgtctttatagtagaatgatttataaacctttgggcatatacccagtaatgggattgctggatcaaatagtatttccagttctagatccttgaagaatcaccacactgtcttccataatggtcgaactaatttacactttcaccaacagtgtaaaagtgtttctatttctaatcatcctctccagcatctgttgtttcctgacattttaatgatcgccattctaattggcatgagatggtatctcactgtggttttgatttgcatttctctaatgaccagtgatgatgcgttgcttttcatatatttgttggccacataaatgtcttcttttgagaagtgtctgttcatctcttttgcccactttttgatggggttgtttttttttttttcttctaaatttgtgtatgttccttatagattctggatattagccttttgtcagatagatagattgcaaaaattttctcccattctgtaggttgcttgctcactgtgaggatagtttattttgccatgcagaagctctttagtttaattagatcccatttgtcaattttggcttttgttgccattgcttttggtgttttagtcatgaagtctttgcccatgcctatgtcctgaatggtattgcctaggttttcttctagggtttttatggttttgtgttttacctttaagtctttaacccatttcgagttaatttttgtatgaagtgtaaggaaggggtccagtttcagttttctacacatggctagcagttttcccaacaccatttattaatagggaatcctttccccgttgcttgtttttatcaggtttgtcaaagatcagatggttttagatgtgtggtgttatttccgaggcctctgttctgttccattggtctatatatctgttttggtactagtaccatgctgttttgtttactgtagccttgtagtatagtttgaagtcaggtagcgtgatgcctccagctttgttctttttcattaggattgtcttggctatatgggctcttttttggttccatatgaaatttaaagtagttttttctaattccgtgaagaacgtcaatggtagtttgatggggatagcattgaatctataaattactttgggcagtaaggccattttcacaatatggagtcttcctatccatgagcatggaatgtttctttatttgtttgtgtcctctcttatttcattgagcagtggtttgtagttatccttgaagaggtccttcacaccccttataagttgtattcctaggtattttattctctttgtagcaattattaattggagttcactcatgatttggctgtttgtctattattggtgtctaggaatgcttgtgatttttgcacattgattttgtatcctgagactttgctgaagttgcttatcagcttaaggagattttgggcggagatgatggggttttctaaatttacaatcatgtcatctgcaaacagggacaatttgacctcctcacttcctatttgaataccacttatttctttctcttgcccgattgccctgtccagaacttcccatactatgttgaataggagtggtgagagagggtatcctttccttttgctggttttcaaagggaatgcttccagcttttgcccattcagtatgatattggctgtgtgtttgtcataaatagctcttattattttgagatacattccattaatacctagtttattgagagtttttagcatgaagggtgttgaattttattgaattttattgaaggccttttcttcatctattgagataatcatgtggtttttggcattggttctgcttatgtgatggattatgtttattaacttgcataggttgaaccagccttgcgtcccagggatgaagctgacttgatcgtgatggataagtcttttgatgtgctgctggattcgctttcccagtattttattgaggatttccgcatcgatgttcatcagggatattagcctcaaatcttccttttttgttgtgtctctgccaggttttggtatcagagcgatgctggcctcataaaatgagttagggaggagtccctctttttctgttgtttggaatagtttcagaaggaatgataccagctcctctttgtaccactggtagaatttggctacgaatccatctggtcctgggctttttttggttggtaggctattaattactgcctcaatttcagagcttgttattggtctattcaggtatttgacttctgcataaatgtcttcttttgagaagcgtctgttcatatcctttgcccatttcctggttcagtcttgggagaatgtatgtgtccaggaatttattcatttcttccatttctgttcatttgcacagaagtgttcacagtattctctgatggtagttcgtatttcagtgggatcagtggtgatatcccctgtatcattttttattgcatctatttgattcttctctattttcttctttattagtctggctagtggtctattttgttgatgttttcaaaaaccagctcctggtttcattgatttttttgaagggattttcgtgtctccacctccttcagttctgctctgatcttagttatttcttgtcttcttgctagcttttgaatttatttgctcttgcttctctagttcttctaattatgatattagggtgttaattttagatatttcccgctttctcctgtgggcatttagtgctataaatttccctctaaatactgctttagctgtgtcctagagattctagcacgttgtgtctttgttgtcactggtttcaaataacttttttatttctgccttaattttgttatttacccagtagtcattcaggagcaggttgttcagtttccctgtaggtgtgtgggaagttagtttcttaatcttgggttttagattgattgcactgtggtctgagagaccgtttgttatgatttccattcttttgcatttggtgaggagtgttttacttccaattatgtagtcaatttagaataagtgcaatgtggtgctgagaagaatgtatattctgttgatttgtggcggggagttctgtagatgtctattaggtctgcttggtccagagctgaattcaagtcctgaatatccttgttaattttctgtctcattgagctaacattgacagtggggtgttaaagtctcccactattattgtgtgggagtctaagtctctttgtaggtctctaagaacttgctttatgaatctgggtgctcctgtatttagtgcgtatatatttaggatagctagctctttttgttgcattgatccctttactattatgtaatgcccttatcttttttgatctttgttggtttaaagtctgttttatcagagactaggattgcaacccctgcttttttttttctttccatttgcttggtaaagactcctctatccctttgtgttgagcctatgggtgtctttgcacgtgagatgggtgttctgaatataacacaccaatgggtcttgactctttatccaatttaccagtctgtgtcttttaattggggcatttagcctgtctgcatttaaggttaatattgttatgtgtgaatttgatcctgccattatgatgctagctggttattttgcccgttagttgatgcagtttcttcacagtgtcgatggactttacaatttggtatgtttttgtcatggctggtacccgtttttctttccatatttagtgcttccttcaggagctcttgtaaggcaggcctggtgctgacaaaatctctcagcatttgattgtttgtaaaggattatatttctccttcacttatgaagcttagtttgactggatatgaaattctgggtcgaaaattcttttctttaacagtgttgactattggcccccaggctcttctaccttgtaagctttctgcagagagatccactgtcagtctgatgggctttcctttgtggataacccgaccttactctctggctgcccttaacattttttccttatttcaaacttggtgaatctgaagattatgtgtcttggggttgcttttcttgaggagtatgtttgtggtgttctctgtatttcctgaatttgaatgttggcccatcttgctaagttagggaaggtctcctggaaaatatcctgatgaatgttttccaacttggttccattctccccgtcactttcaggtacaccaatcaaatgttgatttcatcttggtcttttcatatagtcccatatttcttggaggctttgttcattgattttcattcttttttctctaatcttctcttcatgctttatttcattaagttgatcttcaatctctgatatcctttcttcagcttgatcaatttagctattgatacttgtatatgcttcacgaagttctcaggctgtgtttttcagctccatcgggtcatttatgtttttctctaaactggttattctagttagcaattcctctaacctttttttcaaggttcttagcttccttgcattgggttagaacatgctcctttagctaggaggagtttgttattacccaccttctgaagcctacttctgtcaattcatcaagctcataccccatccagttttgttcccttgctggcaaggagttgtgattctttggaggagaagaggcattcttgtttttggaattttcagcctttttacactgtttttttctcattttcatggatttatctacctttggtcattgatgttggtgaccttcggatggagtttttgtgtggatgtcctttttgttgatgctgatgctattcctttctgtttgttagttttccttctaacagtcatgaccctctgctgcaggtctgctggagtttgctggaggtccactccagaccctgtttgcctgagtatcaccagtggaggctgcagaacaacaaagattgctgcctgttccttcctctggaagcttcatcccagaggggcacccgccagataccagctggagctctcctgtatgaggtgtctgtcgacccctgctgggaggtgtctcctagtcaggaggcacaggggtcagggacccacttgagaaggcagtctgtccctaagcagagcttgagtgctgtgctgggagatccactgctctattcagagctggcaggcagaaacgtttaagtctcctgaagctgaacccatagccgcctcttcccccaggtgccctgtcccagggagatgggagttgtatctataagcccctgactggggctgctgcctttctttcagagatgccctgacaagagaggagtctagtagggaagtctggctacagcagctttgcacagctgcagtgggttccgcccagtctgaatttccaggccactttgtttataatgcgaggagaaaaccacctactgaagcctcagtaatggcagacgcccctccctgcaacaagctcaagcatcccaggtcgacttcagactgctgtgctggcagtgagaatttcaagccagtggatcttagcttcctgggctctgtaggggtggaacccactgagctagaccacttggctctgtggcttcagccccctttccaggagagtgaacagttctgtctcactggtgttccaggagccactagggtatggaaaaaaaactccttcaggtagctcggtgtttgcccaaatggcctcccagttttgtgcttgaaacccagggccctggtggcataggcacccaagggaatctcctggtctgcgggttgcaaagaccatggacaaagcatagtatctgggccagagtgcactgttcctcacggcacagttgctcacggcttcccttggctaagggagggagttccccaaccccttgagctcctgggtgaggcaacaccccaccctgcttcagctcctcctctgtgggcagcacccactgtctacccagtcccagtgagatgagccaggtaccttagttggaaatgcagaaatcacccgccttctgcgttgatctcactgggagctgcagaccagaaatttaaatcactttaggtcacttctgattgaacagatttggtcagttttcttgcagaggctgacatttgaatgggaacttggaaaacaggtatgattttgatagatgaggaaaagggaaggacatcttaagcagaagaagttgaatgagtaaaggcatcaaagtgttgcaatgctgcacttatccaaggaatggcgatagttgtatttggctggattctgggtacttggagagctaatggtggtagacagcctggaaagagagcttaggacttgattataaaaggctttggatcccagtttaaaaatattgaattgtattcagtaagtaatagtcaaggaaaatttgtgcaagtgagtaatctcaggtttgtgttttaggaaatttagccaatggcctgcaatcaagaagtgtgaattcaatcccaagctcttcttgctgtgtgtcattgagtaaattatataatctctttgtgttgtggatttctcatctggaaataaagctggagttaaactacttttcttaatcagagggatggtttgcctgttatataagcattgagagtttattgtctagttattagtagattttctgttttgatggatccaaagtatagggcaactgagacctttactctcccaacctgagacctcagtgaatgtactgagtggttctgttttaaaatgcaattctaagtcctgagcacctttttgcgtgtgtgttggtggggatgggtggaggtggtagaggtgagagacgtcttgatggctcttgacaataatagctgccgtatactatagatttactatgttccaaagtcagtattaagggtttaaaacatattttctcatttaatcaacacaataatcttgtaagaaataccctgagaaacactgagtcgcttgtccatgcatctgctatagagatgttattaaagcaacgcttatgactgtacaacaaaggtatttgccccatgtagtgactggaagattctgattgtaatcagctaattcaaagagccagtagatgctggacctacatgcagttaagtgatgcgggaaaaggggcagagttcaatcccatgctgacaccctcatttaaaatgatgatttttttttttcttggaggctagcctaggaaaagaagtaaaggtgattcatttactaatttgctgaatagtagatatttgaagtgtacattggtcactgatgctggagggaatatattcgtccacattatttttttaatctcagtaatgtattatgaacaaaaaacaacctcataatatttatttatgatatatcttaataaatcctgttttccatttcaccagaagcagtcaggatcgatgtaaactcttcaatctcttggagtctcacttttctcatctgtaaaataaaacatgatatttaacttgcagaattattgtaaacattagaaattaggtatgcaaggcatctaatatagtacctgtcacaaagtaagtgatcaataaaaattgtccactcagcacttctgcctgactttccatataaacagattgctatgattttgtgcaagtaggttatatgtccttttactataacatctttccaaccatttggttctttgaccatgataagttgggaaatttgctcaagtctcatagaaaatgtcaggataccatctatgggctaaaatgttgtggcttacaatattttgtgatgtgatccctgtctaacaccttgttcagccctctcaccagttccctacctgcaaccttatatggcagctaaacttagctattggttttttttttttttttttgagatggagtctcgctctgttgcccaggctggagtgcagtggcttgatctcgactcactgcaagttccgtctcttgggttcacgccattctcctgcctcagcctcctgagtagctgggactacaggcacccatcaccacacctggctaagtttttgtatttttagtagagacggggtttcactgcgttagccaggatggtctcaatctcctaaccttgtgatcctcccgcctcagcctcccaaagtgctgggattacaggtgtgagccaacttggctatttttatctcctctacacataatatttcctcacgatactaaaataactcttctatctctgcctggctaattcctatgctggcattatatcttccataaactcctctatactagtcagagttcttcagagtaataaaaccaataatatatctatatatctatatctgtgtatagatagatttattttggaaattggttcatatgattatagaggctgagaaatcccacaagctgaaactgcaagctggagaaccagaaaagccattggaataattcagtgtgagtctaaagtcctttggaccaggagatgggggtatgagtggtaatagtgtaagtcctagagtccaaagacctgagaaccaggagcttcaatgtccaaggacagaagaagatggatatgctagcttaagaagagagagagaaaattcttccttcctccacctttttgttccatttgggcccacaacagaatgaaattatgcccacccacatggggggcataatttctttacttagtttactaagtagaatgttaatctcttccagaaaaactcttaacagacatacctagaaataacattttattagctatctgggcattctttagcccagtcaaattgatacgtaaaattaattattacatcctccattcttcatccccaacccaggctcttggctgaatttggtactttttctctgcctgtgtttccacacttacttttgttatgttgaggaacacattgaattgccacagttggttttcttaattgtttctctagacaagaagtccttaatggtggggtctttctattatcattatgtgtacctaatatccagagtctggtacacctcctggtttattgttgatcaagttccactaacatttgttgcttgttaaatgaacatgaggtggggtaacaagggtggatggttttctccccagggaacaacgctttcagtgtggcaccaaaagcagtgagtaccttaataatgtaaggttaagaaaatcatatcctttgccagtcaagccttttggttctgacagtggcattaggatatacattttgaaaagagtaaaacaccctcattatgatcaatttttaatcatctctagtgactgagaatggagctatcattcagagatttttctaaaatcttttcaaaaccatatattcaacctgtgttttctctttaagctaacaaaaagtcaaacattcatgtcagctacacaatagtatttatttattttttttgagacagggtcttgctctgtgtccaagctggagtgtagtggcacaatcatagttcactgcaacctcaacctcctgggctcaagcaatcctcctgcctcatcctcctgagtagctgggactacaggcatgtaccattagacccagtttcaccttgtttccccgggtggtctcaaacttgtgaactgtagccatcctctgacctcagactctcaaagtgctggaatgacaggcatgagtcgccatgtctggactataatagtatttaatttggaggcttcaaatcatctttattcaagttttattttaaatttaggcgcctcctaaatttaatataaggattttattaataagtgaattagttcatagctaccctatttctttttcttctgatttgttaaactttaaacatagctcctaattcattttagctgaaatcattttagcctaaggaattctttttatcttatttttttcctttgcaatctgagaggagaattttcaacattttcattacaaacatttcattacaaacatcagaacaaagtctttcccagcaaatgccaagaaaggcattttgatttacatttatgagaacttgaatgttatcaaatgcaagctgaaaaaatccaaagttgtaaacgtaatgtaaatgtatagttaggaaaatctacttggtgatttcaggcatgtaaataactcagtcattcttttggttaaaagccagtttgctaaattctatgactatttttggaaagtatatattttaaagtctattttaacaattgtaatgtttttctcccctttatactgaggtcttttccctcttatagattctgccctgtttcattatgaagagatttttgtaggagggattttctaaaagaatttttctcaatgcatatcaaagagcatgctgtttttgtgatgatctcatggtatatcacaacaaaagtggaaattttctatgatttaaatttatcattttccattcctgtgatgtgctcctttttgtaatatctatttactttttttacgggcaccccttactggctacagcaagttctagttgacatcattcaaacgtagacagtgttggaatcacccaggataaactacaatgctttccatgtagcttgtcctccttttcacactgactccaggcacagaagtaggcatctcatggtgcaaagcacactagtctaagagtcaaaaaaagacatatttctgtcactttctagttgttcttccttgggtaagtctacaagccttctaactgattgtaggacccatataagttagaagtactttctgtttcaggaattttaaaggattttagtggtcatggtagctgactccccagcagcattccatcccaggatggaatgtggattgtagatggaaaatggttttcaaatttggtgtacattagaataacctgagaaactttttaaactctggatgccctggccacatctcagaccaattaaatcagaaactcaggaggttggatccagatattcaaattttcagaaacttcccaggggattccactgtgcagccaaggctgagaaccaccgctcttggtaatacctttgctgataaccagtttacacatgagcatgtggttcaattcttgctaacaaaatttaaggcagaggctaaaggaaaactttgggaaagactgcttaactcccaaagcaaatacaagagacaaagagacttgccaaaattctgaggttgaaaacacttcagagtcagcagagctgccaaatcaaaggaaaatgtaaccaaaacatgacgcatgcccaaactgtaagcttccagttatttgagattataaatatccttattgtgtaaaccagactcccagtttttctgttattagtagctgaaacatcctaagtgatttgctctaaatgagcaacatcaatcttactcctggctgctgtagctctaggttagggttcccaagcctgtggatatatgttagaatgagtataacttgggtgagtcttttttaaattgcaaattcttgaacatcacccagacctactgaattagaatctctaggagcagagcctaagaacttatatttttgcaaaactcaccagaagataacacagccagtctatacactgatgtttggggataactaagttcttaaaaaagaaagaaaaaagttaggaaaacagttactatatcatgcaatttaagatggaaagaaacttaaacattgtctagaataactttattacgtgaaagatacaggaattgaggcacagataagtgaaattatttgctcaaagaaaaacatttagttctttgacaccagtaaacatatttttaatgtatatatttgcatttggtcttcttacaactgaatgtccttttcattctctgtcaccaaattaagaagtgaattaggctcatggcttgtgggccctgtttgtcaaatcatacagcttggaaatgacccagactgcatactaagagacatattcatttattgtttggctaacatgaagctgataccagggacttgtttcacacactgcttgtcctcaaaattgttcagttagtttcactggaatttgtttgctcttttctctgctgtgggagaatgtggttggaaaccaaaggtctggagataaaattgccaatggttcaaacaatacctcgtgctagttttatttgatctccttatgtctattgtcctcttagatttgctttggatattttttccttgctgtaacagtgagtctttaacattcaactgaggccattttaggtaattggacaccatatgaaagcttgtatttagattgacagtccttattccacatatcaacttttatagaatatcactttacattgtgtcaccagcgaggacaatttgcctctacttagcccaagccctggaaaaaaatcaatacattttgatttgcccttccattttggatggagatggaagatagaatttcttcataaattaggttatgtctataggtaaattgtaagtggctaccatagggcaaagctcagatattttttctgagaagcagtaatatacaccttctccacctcactatacactttaacattatcagggtagaattgtggatcttcagatggccttgttatttacgaatttcttatgagcttagaatttgcagagtgaggatgtaggagttctgtactctttatactcaggttacctttgagtaaaatgagtagtggtgtgaggctctgtacatggagggtttatgctcctttatgtctgatggataaaatgtttgcaaatatatgtatatatattaaaatatcagtaatgtcagattctgttctcctgtttctaacattttgtctctttttcttcctcagatctaatgtcaagtgaatttgagactctaaaatgcaacaaatgggccataaaaagtggggaaaacagacagaaaccaggaaaggaaacccacgccgtcccattcccttaggtaccatggaacctttatgtaaggagaggtgacagggtaaaatgagaatgtatggaaaaagtgcaaatgaataaaaatgcaagagatgagttaaaatgttatattgctatagtaatatatttgcattaaaaacaatttaacctctgtgacaacaagaaagctaagtctgaattagtgtttcctgaagtatattcttaagaacaataattatgcaggatatcaaataaaattacatgaaaaaatttaagtgatcaaataatattcaggaaattgggttaaataagacctcttgaagcctttaatactctaccttagagtgtgaatatccataaatgaggctctaatatgcaaccgtttccaaacatatcttatcacattattatttttcaatgaagcattttacaggagtaaagttgatctatatttattagaggtatctcggtaaccacagtaaggatgaagcagctcaaccatctaaggtgaggtggaatggatttcttaaggtgagaaagcagagccagaagctgaaggctggaactgcccagtgcaactgtccttgaagaagaggagcgttagaatggcccatcccacagcctcggcaaacatgtacaccagaagcatggagctgcttctctgaagtttcttaagatttgctggtgcccctcagtttcagaaaaagttatctacaaattctctttaaaacttgcatatctcatgtggtttaattcttattaaaatgcctacttctatttaaacacacaatatgggcacatcgtacacacacacacacacacaaacacacacgaacatgcacactactttcacctcccgaaaaggagtcatactttcgggtggtatccacaaaggagctcgttttgttcctgttgctgatctcatggatttgcgagccaacattcctgtgaggtgctggctttcagctatattcaccaggggctgcataggaggatcaacatgaggcacctctttttgactggcttttcttcaggcactaaagtcataaccatcatttattgaaacttacactgtataaagcatttctgcattgtctcttccccttaaaacgaccctatgaagtagtgattattctctgcatcttacaatcgaggaaactgaattgggaagtttaaacagcttgccaagattacacagttgtcttctaatatgcctgtactttaatagaagttgaagaaggaaagtatcgatagcttcaagaggacaataaaaaggaacagttactcctgataatgtattaatttgtaggtatctaagaagttcaaggtggcaacgatttttctctctctctccttctgtctctggacttgataaaaatccttctaaattctctattctattcaatagccaattttaccaatctcctataaaaatgatcaaatccaatatgtgtgtattagaatgaatacataaaaaacttttataattttttcaaaatctcgcactcataagttggtaagtcaaccacggaaaaaaacctcaaatataaaattaatgcatttaatggtgtttacgtttttattaccctgtaattatatctttcctgtgattgttttccttttcatgctggcctataaaatgtggctgcctcaacctgttttaaacatctacatttgtaggattaggactagtgatgttttgccagtttccatgaaagaagccagatgcactgaagcaacctcctttgatagttaaagtccttcattaatttgacacctggcactcccagctatggtcttattcatttttggtagaatcgttctggtccacagataagagcatattctctgtcatgataaatgaattatgaaattccctattgtagcgatttttatactctgctgttataacttacattagctatcctcttactgtaaatattgattcattgcaaagtgaagactgtttatatttagggttgcctagtttaagaaaattttccatatcatcttttcccttgctataaaattcttcattccaaaggcacttttaatttggcctcatttattttgtagtatttcaaatgctgccaaaatttgcataagtgcatggagacaaaattaagtccagattttccaagatggataaatttgtgggtggttattttttcttctccacagaagggttgattgcaaaattccagtaaatgacaagttttcaacataatcagttttctagaactccatattctagcaaattttcagaaattaatctcttacattaagtgagttaccctatgtatgcatgtaagtaaaaaaaatcctacttttaaaagtttggatttgtatctggaaactaaaaaagctattaattttgccatacacttatgttatcaattaaaatacttttgcaataaataaatatctaatagtttatatatatgatataaatatatactttatacgtaagaaatatatatatttccttctggcatgaacccaatagtactcaatattttaacatttgttgggaaatccctagtaaaccaccaggtttttacttaaattaacaaatgatcagcctttaccccagaatttttttaaagaatacaaaatattaaattgctaataggtatttcctgtttaagttggcctctatctttatctgttctgctttggagaggttccataccactctggcttggaccatgtaatccagtacttgccagtcaaagcagcattgtgtaagagcatcccatggctcttccttgacctacatctcaccagctttcatactttcccctttcttcctcccctacctgcagcacctgaagggcataagggtagttccatgactaccactttaattctgtaataaaatgttgctagaggaaaagaggtcatgggctaagtgtggagatgaatgctactttgtaaactgctttgttatccactatttccacacttggtctttattttttttattattttattttattctattattactatactttaagttttacagtacatgtgcacaatgtgcaggtttgttacatatgtatacattgccatgttgctgtgctgcacccattaactcgtcatttagcattaggtatatctcctaatgctatccctctcccctccccctaccccacaacaggccccggtgtgtgatgttccccttcctgtgtccatgtgttctcattgttcaattcccacctatgactgagaacatgcggtgtttggttttttgtccttgtgttagtttgctgagaacgatggttttcagtttcatccatgtccctacaaaggacatgaactcatctttttttatggctgcatagtattccttgctgtatatgtgccacattttcttaatacagtcgttgttggacatttgggttggttccaagtctttgctattgtgaatagtgccgctataaacatacatgtgcatgtgtctttatagcagcatgatttgtaatcctttgggtatatacccagtaatgggatggctgggtccaatggtatttctagttctagatccctgaggaattgccacactgacttccacaatggttgaactagtttacagtcccgccaacagtgtaacagtgttcctgtttctccacatcctctccagcacctgttgtttcctgactttttaatgatcgccattctaactggtgtgagatggtatctcattgtagttttgatttgcatttctctgatggccagtgatgatgagcattttttcacgtgttttttggctgcataaaagtcttcttttgagaagtgtctgttcatgtccttagcccactttttgatgcggttgtttgttttttcttgtaaatttgtttgagttcatggtctttagatgagtggcatctgaactcacttctgatgcttgtttaaaatgcagacacctatatcctgctccagccctactgaagctcggggaaactctctggagtctgcaattgtaacaaggtcccaggtgtttcttatacatactgaacttcaagaaccactgttctagatggctagacggacttctttgtacacactgtaaaaagaaaacaaaagtatatgggagacatatgaagatggtaaaatgaggtgacacctgaataccttctagagaaattctgctaaaatatttatgaaactatttttttaaatccccagaaagcacaataaataacatgaagtaagcactgctaggctctgtgacattttcacaagtgcttaccatttttaaagacctgtttttgatctctaaaatgcattataatctctacctcataaagggttgtgacaattaaagagaaaggcattaatcaaacaagctagtgcgacaccaatatataagtagcatttaaaagttgtccacacttcactcttcccactaagattttccttagcctctgatcactccaggctgggtatgcaagccagttatttgaaaactgtgcaccacagaggtctgagagcctttccttaccagtcaatgggtttgatattattctagagccttgaaccccaaattgttagggcatcagtttcactgaacctatacttttttcctgattcccagggtttatacaattttgtcctgcctcctacctattatttatgtccacccaggctttgcaggaactatgatttaggtaattttcagacaccaacttctagtgagatctgaaagtcccctctgctatcttcttatcctttatatgtcaatgtccactagcctaagacttatattcactgttccatcatggctccattctgctgactcttagaaggagtctcctggaggttccttagttcccactttcctgctagccacagatactctccctctcattccagaatgtatcatagcttgaaacttataccactttctataagtctccattcaaattgtatgcagtgagtaaaaacccttccctcgtcttcagccgctctccaagattgctcttctatgtatacactatcttgcctgaagttttgattcaagttccctacataatcatttatggcacagactagtcaaataaaaatttacaccaaaaaaaccaatggtatcacagaaagtgacaaagtgttaaattgtataaaatctacaagcatctaagcaagaaaaaaaacatctattacaacttactgtcaaaagagcagaaattagcttatttttaaaatgtgtatatgtgtaaacatgctttctgaaagatcacagactgacaacaacatctccttcaagaataaaagtgagacctaggaattttgtattaaaccaagctacatataaagaaaataggtgggtgtggtggctcatgcttgtaaccctagcactttggaagggcaaggccagaggattgcttgagtccaggagttcaagaccagcctaggcaacatatggtaggccttgtctctacaaaacttaaaaaattagcctggcatagtggcacacaactgtactcccagctactcaagaggctgaggtgggaggattgtttgaatccaagagttaaaggctgcagtgagctagaatcacaccattgaacttcagcctgggtgacagagtgagcttctgtttggaaaaaaaaaaaaattaaacaggaaattatctgattcctaacatccttgaaatataccacttgtgtctttactattaaaaagttatgcataggctgggcgcagtggctcacgcctgtaatcccagcactttgggaggccgaggtgggcggatcacgaggtcgggagttcgagaccagtctggccaatacagtgaaaccctgtctctactaaaaatacgaaaattagctaggcatgatggcgggtgcctgtaatcacagctactcagcaggctgaggcaggagaatcacgtgaactctggaggcgaaggttgcagtgagccaagatcacgccactgcactccagcctgggcagactccatctcaaaaacaacaacaaaaaaaaagttatgataaagagaaacttcgaatatttaattatcttttcccattgatttctaatgttttcagacgtatgttctcataggagttgggagggagggacaacaatcacttgaaaagatgtttctgtttttcttggtcttggtatcttttatttcccagatgtataggtcataaaaggattgagtatgtcatctagtcatcttttggataaatattcaactgataacaagttaaattttatttcttagaacagtctccttaactccatgaaagctgaatatgtaaagccaatcactatacacaaatgattctatttccgatgtccttttacagtcttaaagagtcagctaagaattttcttccataaaattcagtttgttctggttgagaggaggagggcaaagctcctactgcatctgcctttagagaaattccaataactgtcttgttttcagtttaaggtaagtgatcatagacattgaacatgactgaaaatgttttctccctctctcttaaattcatgtatttattcagcccgccaaaacatatcatgccagggaccatcctaggtataaagaaagaaaaacataaataagacaatctctacccacaaagaagttgaatcaagaagaaacattaaaagctggatgctgcttctttagattatataaaattttattttgcaatgactcttggaaaatgcaatatagagttatagaaaatatatatgctgtgcatataaagaaatgatacataaatccaattgacttcctcagctttttaataatagctttcatttatttagtgctcactatataccagatcctatactaggtactttaaaatttttattttctataatatttacagtagttccattttgcataggaggaaaagagctttatctccattttacaaattaagaaactgagcttagaaaagttattagtcataagaaatattaatagtgtatggcaaaaagaggttcagctcccagtgtctatggctccagagttggtggctcttgacttctctgctatcacatccctacaacaaatgtggggacaacaaacgtgtcctgtgtcatatacacaaagtgagattaacttgtttgtagaatcttctcctcatggcgctttcttgccatgcagtgtgatcttgattgacatttgttccaatgactggacaaggctgactcaggagtctgctgtcatttgagctgatgcagggggtaagaagaaggtggcgttttatagccctttacatattctgttgaaaatatatatttacaggcctggtgcggtggctcacacctgtaatcccagcactttgggaggctgaggcgggcggatcacaatatcaggagatcgagaccatcctggctaacacgatgaaaccacgtctctactaaaaatacaaaaaattagccgggcatggtggcgggcgccagtagtcccagctacttgggaggctgagcttgcagtgagccgagattgtggcagtgcactccagcctaggcgacagagtgagactccacctcaaaaaaaaaaaaaaaagaaaagaaaagaaaatatgtctttataattagaagccttcccattagactgatgatttctaaagtatgaggttccttgtctttctgttaacagagactacattatgtcagacaagaacagccattcagtatctggtttggaatgaatgatgcaataagataggcagatacagtggacctccccatgacatctgtgaagtcccagcaaaaatacaaatggaaaccttcagtccatggcctcccaacttgcttttctcattcctcactcattcctagatcataagggaccttgaaacttgtatgtggatactctagcctgttatgtgcaaggtctgtccacactatgcaaatagaattcccttggccacttctttggcctatgctatgccctcaggaggatgggccagggaacatgcttattcctagaatagagcttgggtccactttggacatagaactctagaaagctgtgtctcagatcatagtctagaaaaggtctgggtgagccaggcttcccttggtccctttgacctttaaccctttgtgaagggacaccataggaaaactagatcagagcccttcaaaattcagggtctaaaggtggtactggatcttgctatgacctactttatagaatgagaaaatagaaactcagacacttcaagtgcttcattcaggctcaaaaacttagtgaggagatctagaacatgaaccagtgacttctagtgtcaaatccaagatatcttccactctactcgttgttctattgtatttgtatagggaaaaatgacaatttttccaaaatatttaaaagaaataatttctctcttagcatttctctgcatgtaaagctgggttctccctctggatatcacaaaaagttcacaccaactttattacctcgagcctctgacctctaacgcaaagaatgggactgattgagagacagcaaatttgtaagggcttctgtcttctgtggagcagaagtgtcaaaagtgatgcttgttgtgttgaaaaaaagttgaagttttgtaagagttgtaaccagagatgtctccttatcataataggtcactcgttcaaaaaggtttttaatttggacaggattgtgggaaatgagcattttctttcattgcaacgaccaaactgaacaccaagtagttcttactatttgtatctctgggttctagtcaatattttacgtaaagatcaacttgatatatatatttcattttaaacttcaataaggacatgttaaaatatgaggaagaattaatactagtttttcatgttccattataattatctttgtgattgaaaccttctttaaattgaagaggaaaatgaagtttcttatggacactgcatttcagcctctaggcaaaactttgacacaatttaacaacaacaaaaaagaggtctataagtttccatgcaagtgaaaaatggataatatttatgttattaatcctatgagggagatggtatttctcattttaaatccttctatgtgtatttatgatgctttggggagacaaacatttactctgacatctgccttaagtaccagaaacagaatgaaagtgtgagaagaataaagaggatgcactaggcttatttttgggaaatatgagcctagacctgtgaacccaatatatatgttatatgttgctaaccactatatgataaagaagaaacaagtctccaggaatgtgtgtgggctagtgctgaacctggacaggtttctgtgcttcctacaaatattcctggctgcgccataaatcccagcaaggtgaactacatttcttggccactgttcatcctgttttcagctcatccttgaggttggttggatgctctcacagaggatgctaatctttcaggcttctgagctcatgcagtccttctatccttttgaaagcacaaatctcaccagctgaaatcagtcattatttccttagggaaccaaatctaaacactagaacttctctcccagcctgtaattaaatctggcgggcaggtcaccagtgccactgggtcaggaaagagaagaaaaaggaagtgaaagaaatggcatttgtttcttggctggccccagtgcttctctgagaggtaggctctggcagccacacagtggagtccctgtgcccagaatattcgtgcccagaattgtttcgggtctgccagctggctccaaaaaggttctttccaatcagggtcttgcttgctcactcagcacttgaagctgaagcacattgctggtggtctgttgctgccccaaaagaattttccctaatttaccacctctgattatgaaacagcagagcttatcatactttaaaaggtatcagaatcgctcagaaagcttgttaaataaagattcctggaatttattcccaagactttgatttagtgggtctagagttatgcctgaaattttgaatttctttttattctgatttattcatttatttttcttaattgacaaatataaattgtatatatttatcatgtacaacatgatgttttgaaatattataaacatgtatttcaaatatatgtggctaaatcgagctaattaatatatgtattataagttaatatatacttttatatttttatattatataggtattatagtattatatgttaatatattatatgtaaaatatatgcagctaaatcaagctaattaacatatatattaccttatatacttattttttgtggtatgagaacacttaatatctactctcctggcaattttcaagaatacaacacatttttattaactatagtgaccatgttgtatcatagatctcttgaacttatttctccaatataactgaaattttgtaccctttgacaagcatctcctcaacccaccctgccagcccccggtaaacacaattccaccctcctcttctaataagtcaattctttagattccacatataagggaaatcatgcggtatttgtctttctgcgccaggcttatttcacttaccataatgtcctccaggttcatccatgttgtcacaaatgacaggattttcttcttttttatggtggaacagtattccattgtgtatatacaccacatttcctttatctatttatctgttgatggacacttagattgattctgtatcttagctattgtgactagtgctgcaataaacagaggagtgcaaatatctcttcaacatattgatttcatttcctttggatgtatagccagaagtgagattcctggaacattacgaaagctctatttttaagtttttgagaaattttcaaactattttccataatggctgtactgagaatttgcacttctaacaaaatcccaggtcatgcagatgttggtgatcgacagccacaaaaggctatggatgattgattgttttcttccttagtcgcccagattttagtgtctaattttaaagttaaacatggctattatgttaacttttactgtcatcgcatttgcattcttcttatccttactgcttattttctatttctatttttctttcttactgtatatgattttcgttgaagagggggagtgtttactaaattcaatgacttttgaaactaagtagggttttcttatttattctactaagtaattatacttgaagctatctacatcaagttttattctgttacggaacaggtaagaccccagaaagaggtaccagaggtgatatttggataatatctacccaattgaataagaaatgttgaatttaatagattcatgcctcctgcaataaagtggggtccaaatgtaatatctgccctctgacaaagaacttccctgattctgtctcatctgtgtttagttttggtctaaatgcctgaggttgctacctcactatgctgctagttgggcttctgtctgttccatttgggcaggaagaaaaagagagaaaatgaaagcgatgtggtttgtctcaccctgccttatcacaaggttcttacccccgagtttggggtgaggttcaaggaagaatgagaatatgactcagatgccccatcaatacattttcccaaataaaacaagaggtgtatgtagctagtcctgccttactatcaaatatcaaacttttcattcatttgcaactatttttagtatatcagcaaagtttctcttaggtttcaatgtagttaaggcaggctatatactgtgctaaatactgattctaaaagtgttatttcccagccagtctgtctctctcccaaagtaaatgtagtataatgcaattgagtagaagcaatgttgttggaaaggtaatcttaaatcctccatgatttatgaaaaattaaaagtaaggcctttgcaggcttggcatgatggttcatgcctgtaatccgagcactttgggaggccgaggcaggtggatcatctgaggtcaggaatttgagaccagcctggccaacatggtgaaaccccatctgtactaaaaatacaaaatttagccagatgtggtggtgggtgcctgtaatcccagctactcggaaggccgaggcaggagaatcgcttgaacccgggaggtggaatttgcaatgaactgacatcacgccattgcactccagcctgggtgacaagagcaaaaaactccgtctcaataaataaataaataaatgaaataagtcctttgtaaacattgacaccttattagttgtgcatttttttgtcatatacttcacagctaactgtggcatgctaagatgtctgggctcttatttgagtcttttaacgttggttagttgctggtcatcatcattttggtgaaaacttactttctattatgtgtagattttttgatcttctgtttctccactgccttctcatatctctgaaaattactacttacatgcatttaacctgaaaaaaaactcaagaccttaaagaaggtccagtggtctgtatgaaatatttggaaaataaagaagaacgtattcttgggaagtaagaaagtatcattagaaagcttgactttgaataggatccatcatctctcatccagagctatcaatctgttacctttcttaagcaatttactctaaagggagacagatagaaagcccacatggttgaaagaggtacgagataaacagatatacccaaatctatatctatctatctatttaatctaccatctccagaactagagaaaataaaaagaggaagattttagtagctgctgttttggaaaatataattaaagtgaaagtaacagaaaaagatttaaataatatttgttatacattaaaaatgcaatcctttttgcttttttcatagtctgtactacaaataaaaattggtctctattatttatgctcaaatcatttcactgcataagataccatgctgagactgtgccaaatgatctgctttaaaaaggttagaatgtcactctttcatgcaatgcaataagtatttatttttcatttgtttatttttttccctatggtagactctgcttcagaaaatcaaagagaagaatacagttctgcttgcaaagtttacaacctggaaaagccacaggtttggggacggagaaacaaatacctgtgacattaagcaaaacaggggtacttgctacagtagaagggagaaatgacaagaagcagtcaaagggataggagaagaatccattatgtcactcatgctaatgcaggacgtacgcggtggtgatcaatactgcagattggctgaaagggataaaaacacagaatagttctctgtaatttgagatcacaggtcactactctccttaaatacagcattttcagcaatcagttgggactgaagctcactgatagtaattgagagtaagctagtagtgagacatggaggcaagtcttttaaaacattagaaagaaaaagaaaaaatgacagttttgaatataacagatttgagggaagagattatagactaggtgaggactaaaaatgtttgtaggcaaggaaaaaatgccaggagaagtagaatttgaggatgaaaatgttaaaaataaaaacaagtcctagaagttgaacatagaagaaatatagaagaaaggaagtctcttctttgtcagaaatttggaggggggttaggaggcaggtagagactaaaggaaaacatagagtcaaagagatttgaggtggaagcaagggatgctaaatgaacaaaaaaggcctgaagtttctgagcatagttgaagccgaagactctattaagtctatcagttctcatggagaaagttagagagaggtattcagttctagaaaaatgatgagtgattcaccatacccttgctatgcagtaatgagggtccagctgaagtcagtgagcataagcttgtaataaaccaaggcttggattcctgagattaagtacagaagtgcaaggcaacatgagcttcccctggctggtggctgctgctgtgttcatggctacactgtgacccactcatgaaaagtcatttaggatatcaataaaggcaccctgagactcaaagtgttaagagacctttgaagcgttcaagagaaaaattataatgaggatagagagctgactggagtgaaggaatgaaaaagcccaatataggggaatgaatttaggagcccaagaactttgaggtggagctgtgtcacttctattgggaaggataaagtacagtgagaccaatcactgcagtcagcaccatggatgatcaaatcattgacactgatgatgatatgtaaaggagaaaaggattgtgagctatgtactaaaataattgaaggtaaaatagaaaagaaaaaagggagacacttggcatggaaaaataatggaaagctgccccaaacagaggaatataagtaactcaacagtctactcctgaacatgcgcactataaatgagaaaagtgggagaacatagggacaaaaagatggctgataagaataggtagaaaatagcataagcaatagcatcaaagtcacgttgttcttgatatgagagggttgagctaagtactaggttggatggtgcaaaagtaattgcagtttttgccattaaagtttgccatcaaaaccatattaagaatttgggattttggccgggtgcagtggctcacacctgtaatctcagcactttggggggccaaggcgggcggatcatgagatcaggagatcgagaccaacctggttaaaatggtgaaactccatctctactaaaaaatacaaaaaattagccaggcgtggtggcgggcacctgtagtcccagctacttaggaggctgaggcaggaaaatggcgtgaactcaggaggcagaggttgcactgagccgagatcatgccactgcactccagcctgggcaacagaatgagactctgtctcaaaaaaaaaaaaaagaatttggtttttattctaagagcaatgggaaggaattgaatgatattaggcagtatgattaactggtatgatcaaattttacaattttctttatgcatggtaaatagattggaggggtgaaaatatattttaggagtccatttaggagacaattatagtagtgtatgtgaactgtgatggcagcttgtctaggatggagacaggcagattagagaaatatatccaagtacaactgacaaacttggttttaaaggtcagggggagagctgacttctgagagtctggcagcggtctgcaaatttatatgaagggtcagataataaggattttaagtgtttcaggctctatcgtctctgttacagctgttcaactctgctattgtagtgcaaagcagccatagccaatacgtaatacgtacaactatgttacaattgctctttacttgtagacgtcggaatttgaatttcacataatttttatgccatgaaatatttttcttttaaagtttttttaaccatttaagaatattaaaaccattcttagcttactagtcatatacaatcaggcagagggttggatttggcctacagggctatagcttttcaacctctcagctggggcaacaaactagaagttgttgctacataccgaaacactggaagggaacgaagaaaacgttcaaggattgagagatgtttattgtaggaaaactaagttctaaaaagcctacaaaaagaactgttagaacagtgggtattaatgaattatgatggggaaaaaaagaaaatgtagctttcagattacttggtggaaagggggaatggaaatttactggaattagaaaagtggggttttgggaatcttctgcaactatgccattaagggtctatgagtaaataacttctggcataataaggtctatgataaaggcttggatattaattccataacatattacttagtgagtaataaactgtcattgataatccaaacaggcacaccctcagtttaggactattacctcagcttgagtcactggtcttccataattaggaagtgatttctgcacctctcatctccacttggacaaaccatagaggctccagacttggataaagatgcctcatttgttgacaaaagtggtgaattaggcagggtgagggatttcgattccagaagcagaggcttccttagggactccacagcaaattatgatagaagtagcataaaatagaagtctgttttgctcaaaatcttctaaagcaagtttttgtcactaatttactttgttaccttgagaagtcaagagaactaagaagcaccaactgtctaccgcttaccgggcattaaaaatatacaattttaattaaaacctccatggcattcctagcaagtaattattattatctccattccatgaaagaaaattccaagaatcagcaaactcaagtaacttgtctaagtttatatagttactaagacagaattcaagcctggttctgtttgactccaaaactcaagcccttatacaaaaccatactggctccttgaacttcagtttgctcatctgtaaagagaagaaatgccattaaatgatttatcatgtctctttggtctccagcactctgtaagtttagtttcatagaggcatgatggccataaggagcaggagacatggaaatacataatgtgcctcaacttgtgacataattttccttccaatttaatgccatcgtctgaaattatgagatgaatgcatgtctaaattcaaagttacaggatgatactacttcagatttaaaatcaaaaagtgtatgaattatccagataggcaatatgagccctgggtattcattcctttcaaacttttccaaaaaatttttaaaaataagacaaaaattatacaatgtgccaccaacaagcatgtcagttattgaaattattaggtaaaaaacttactaatcaggtttttgatctgacacttttttaactgacaaatagtgaagcctttagaagtgatttttttctcttagtgtgctgctgttagttaagtgctttgtactttgatggaaagcattagacttgtcaaaatatttcccacacgatcactgggtaggaggtggaatgaaagacagagagaatgaaccaggtagaaccctccaatgagggggaaccatgagcaacaacgttccaggaaagtttctacactgaaaagtgtttctaagcagaatgttaaacataaatggacatggcagcaaccatcattttggaaaatcactgtgtagacatttactaaatatcataatgatacttactttcatttacatttgtaatatatgagaaactaatatgacaattataatactctccacaagtgtgataaaaggaaaggagaatacaggctttatactgaaaggaaggaaaaaagaaggaaagaaagagggagggagagaaggaggaaatgaaaaaaatgaaattttttgccaacttctgagttcacttttcaaagatttggggttttctcctttattcctagttgaacctttgctttgtaaaagttaaattgcatatgcttaaaccaataaaggtcttataataagttgttgctgttattgttgttttgcaaaagggggcatttttcttttcccttttttccattattttgaatccatatttattagcagtttagacacattaagagaactcacagaaaacttccatagcactatgctctcaactttatatgaactttatataagtgttcttatacatttgtaatgttcctagagtacatctgcagggttactcttcaattacattttggagctaagtgacatttacgagcattatttttattatatttgtaacagaacaaaacaaaataccaccacacattttggtattttactttaaaaatgtttgaaatctaacatcaaacataaaacatgtaaagaggatatattgtttttttattttccttgctataagtaagctaaagattataagttgtcattaatgatatttaaaaagatatttcagcagatattttgtttacaccttgaaaacatccaaatgggcaaggtgcggcggctcacccctgtaaacccagcactttgggaggccgtggtgggcagatcacttgaggccaggagttcaagaccagcctggccaaaacggtgaaaccccaactctactaaaaacacaaaaattagccaggcgtggtggggtgtgcctgtaatctcagctacttcggaggctgaggcaggagaatcgcttgaacccaggaggcggaaattgcagtgagccaagatcgcaccactacactccagcctgggtgatacagcagactccttcttaaaaaataaaaattgaaaactaaataaaaatttaaaaaatccaaatgattcagctaattcttattcatatttaaagaaagtatttcagagcaaagtataagagcttaatttgttaaattctcctatcccacagcctgccaagccaaaggttgaagaccagacttgcccaaacccatagaaagtgagaagatttcatatggctgtgtatgggagctaagtgcttctgttctgattgaatgtgtaaagaaagggatagttaaatgcacagcttttttgactttcaattttccctgacattttggggaaatacagctttcttaacctgtgtgaaaacagcagattactgagtaacacctgagaggctatcaaataaatattttctgcactttcgatttctttattatgccacaagttaatttatcttccgtagagaaggtagggtaaaattagccacagagactgaaagtgactctaaatccctgaatgttataaggatatgtgtaagcaagtaataattatgacttattctctgtctttcatgcctacttgcttagtcaggtgtgattaaagcttaatcagcttggaacatggttattgtaaatatcataaatagatatactaatttaaacactgaataaagcatgaattgctgcgtgatttttatcaaaaaggcaaggtatgactcatcagttcctttctcttaagtaaatgacctaaacaccatgctgcacccacactaagattaaatccaaatacgtcctcccacttgtccatcttttctatcaagtcatcctattctattctttggatgagtcctgtgattttttttcaatgggtcagagccaatcacgggttatttcatctctgtgacaccagtaaaaatgttggattcagtttttttaaaaattattaattcatctaagaggtaatataagtaaaacaactggggacttcgggaatttttttttaatttacagtatttgaagacctgtttcagtttgccaaagcaatctatacatacatataattgcttttcctaattgctccaaataatttctcaagtttctgacttttcaggcaatatggtatttatcatatatctcttaccagtctagaacagaaacaaattttttaaatgaaaatgtgtttttctattacttttcttctaaagataatagtttccacggcttctttgaaacattctggaagtaaaatatgagtgacataaggcaaaattataattgttgaggatgatatgatattacaaagaaatgtgtttatttccagattctcagctctgtagaagaattcaatgtagtgttaaatttgtccacatgcagtgttaaatttgttatcttttgttttatttctcccaaaatgagcataaatgctattgggaaagagaggtcaacgcttttgaatataatcaagatttaatagaatagattataatttatattttataatgctctgaagttgaagccaaaaactgcttctaacctagaatcaggttgaaatgtgttattaagtcttgattgagactattaatttcagcaagatccttttttgcaatttttatacttttgtaattatttaaaagtccagttattttaaatgtatgggaaaatttgctttccttcttttttattttttgcaaaaaaaaattcaaaaattagaaaagagagttaaaggaaacttcatgtatatcttctattataaacttttggtgatacaaaacataatgttactgaaataggtcataaataatttgtatttcactgggatagcagaattagataagtaatttactagagtgaagtattatgttctgaattttaaagacaactttagcatgaactttaataccaaattacacttcaaaagttgaataacaacaatgtcacggttacacatatttttaaaagtacacatttgtatatgcaactattttaaatacatgctgctgtttttcttatctgccttggatttttctaacttttataagaatgtggaaaagaaccattttattttacctggtaaatagacattacaatctacagtggtatggggagctgaagaagatttctttataactagagcagtttcctaacagaatttgaactttctgcagatatgagtctgacaggtagaaaaaccacagagcagccaggctcagctgggtccagaacatttgaaagactgtcccaagaatcctggcagcacccagatgatagtgtgctcctttcgacagtcactgtattcattccttggaaaccagtatcaggctaagaattccctaaggagcatttggcagccaggaaactgattccagccctgaaagcaatgttctccaaacttcatttaccccttaaaagaacatgaaaatctccataacctcttgcaaaagtttaaagtgatatctaaaatttgtccaaaatgtaaatattacaaattgtgtaacttccaacttttcttaaatattgatcgttttatattgttttaaaattgttatataattttaaaatgcatcttatgaaatttagataagaaagtgatttaatttcctgtcatcagaaatctaagaaaatagcaatccataaatgaactcttcattaacatctggaaattttacatcttctctctattttttaagcctattttaaaagttccctttcgcatcaagttttatccaaatttcatataatttaattcacaaaatataattttattttattcttaaatcttctactaatgaccctgttatacttctttgcagcaaaaatataaaagaaatataattttttaatttcctaacaggttgtaaatgttaaaaaatatttcttctgtaatattacaagtattagtagtaagcatgtattaataatgtatcaaaatacattctattattgaatcatttaatataactaattaaaatattaaaatattgataagtatacattaaatctaaaagaacaaaattatctcttaacgggttttggtttttccctcatagatctgtatctgaatgctacttattgctagaataagttagagtttgatattacttctattcttgtcattttaactgaggtaaacgctaaaacaaacaaacaaaacctttatttatgaatgagaatgaaaacactttttaattacagttatgacgtttaattcttggacctttatacaacttttgtgccaaaaattactgtcaatgcaaaagtatttttaaagatctatcagcgaaaaatttgtttagcccttcttcattttagcagaaggcaaagaattagagcccccctgtgatttgttacccagacatgaaactctccctcttccacgcctacaccagctgaagtgtttttccctccaagacaatgcttcatattaagattccaggtggaggaaaagcatggcttctttgtaactacagaccgttttttaggaaagaattcacaggatacgtgtggctgtgaaaacatccttaacattatccatgcccttagaaagtctttgtgaacctccatataagtacttttgttgaggaccactgtcttgcatctgtggcacttggtgacctaagaagtattaaagaaaaaataaataggaagatgggctgttttcactgcatgcctactgatggtttttctgtaacagtttgtgattatttcttaaaacctgacaaatagataagaaacacaagtcagtgtgctacaccaagaaaggcctggatttaagaatccgaaagcatggtttcaactattagctatattcctaattggcctctggaaaacttcactacatttctctgggcctcagttttctcatttgaagcctgggacagtgtttccgaaagctaactgagatgattttaagtggtgtatgtccaaacttgacttgatacacatttcttttattatttatcaggaaaaaatagtcaatctactaagtccatgatccttgaatatagttttttagaaggtatctaaaggatattttagttttttaaaaaaataatctatttagaaaaaatattaaataactagatatgttaaaattcatgtgtaggaattaatgaagtttgtgaaaaactagaagacttacaatttccatggttctgtcaagatctagcattatataattctataaaaaacatttggaaggaaaaaaaagaaagggagaaaacaaggaaggaagagggagaggaagggagaaaggactttaagaaggctatgtatttctaggtagacttgtaaaacctcatagtcatggatggcaaatagcatcccacgcaagaaagttcaaaaggcaagttcaggcaaattattcatttaagcattaatgaatagatgttttaaaggcagaataccaattatgcgaatcagcctttcttaactctctgagcttgagctaaaaatcttcacgatgtctatatagccaagtgatgaggaaatctgagtaattacccaggaaaggcaagcaaataaaacttaaccacaaggctcagaggactgagttacatgcctacataggctgtctttactgatagaattattcaggtaatctaataacccccttatcacatggcctatgttgccacagccaattcctaatgccagacttttagtcaggatagcttacggagaataaatgttctgcaaatagtgtaggtttttccaggttagtaaagaaattcaacttttcaaaaaggttatccactactcagagacaaagaatagactgaattaatgagtattcgtataagcaatttcctaagccttatagatttagaatatgtgtaaatgcatccagctagcaatattaggatatttttagcttcatttttttagtaatatattaagagcaaactccagctttccttcttgttccttcttgtgtcctaatccttaagatcaataaaacgaaagttgttcagtcaaataaaaatatttagtgtgtacatgcacagaggcacacacacacatacatacacacatgaacacaggtacacataaacaccaccaaacaaaatttatgttagaattgcttcaattaaagaataaatcaatccaagaagcgtatgagaaacattatctcagctatgccctaagctaattccttttttgtcctcttgtcttatattctaacaaaggaaagtcactctatttggcctagtctacagtgtttctcaggctctaagtgccttttctccaaataaccatagtaactctatatttgttgttttactaagcatttttccacccattttctgtattaaatataacagccttatgggataggaacacctaaagaagaaccggacagtttctctgagcatttccttttgctagaaaagtttagaataataagaaagcaacactaataacagctgccatttattaaacacttattactactgaggagtttttaagcacaaaaatatttcttattcctcacaacattgaaaagagatattactttattttatagatcagtaagatgctctgaggttgacattctcagggttatacacacagtagtggcagaattggggactgaacctaaattgatattttcgtgaaaccagaaggactttcttctatttcaccccactcccttactaatggttctcacttaatgtttgttgagtgaaacctaatactcagacatgctcttttcaaatgagctcaatagcagatgtctgttcaaatcccttaggtaattagaagtagaaatggttggaaatttcccaattgactatgagtaatagtgaggccatctgggtaatatataaacccattcacaccaattcttctccaaatgccccagaagcattattacttagcagagcaggccaaagaaggttaaccggctgctttaaaggaaaggtggggaaagaggagctttgctctaacatggtcaggtcattctactgccagtaccatcctggaagggtctggtttcaacaggtgtcagtccagggactattacaaagaaggaaacggaaaaatagggcagcacacactttttaaaaagtctttccttatttattcgtaagttgaaaggagagagtgatggcagaatgtgagtgtagtatattaagatatgaaatacaacagctgaatgagtagagtgttttcactgttctggtaagaatgaaatacatgggtatattcaaactaaatgctcttatatatgcatttcaaactggtattgctcaatataaagatatatgatgaaatgataaaattcatgccaataatttaaattaaaatcttctttatttagaacattaaatagcaaataaaacaccataagaagctgaagagggtctgtcaaaggaagaccaccaatctaccaccaggagtcgatttcagttcccctaaatatccaagcatgagggaatgctggcaatgtgaacgttcaatggtaaagtatctgaggattttgcagatgcaggttgtcaaactcatcattaatggaagtaatcaagagctctaagcatcctttttcttttccataagttccagggtgcatgtgcatacattctaaatgctggtctgttaaaccgatgtgcaaattttcaaggactatgccaaaagataatagcagcaagcccacattcaaatgctggagaaaaggaatgggctcatgacaatgagcaagttagataatgcttacaaatcacactcgggaggcattttcttcatgttcacagaatctgtaaaatccctttgcagcagagtatggcatgttttatttttttctttttccaagttaggtaacaagtttagaatatatctaaaatttattggatactaattgtgtcctagggtctctgtttagaacatttatttgcactgtcttatttaatccttacaacaagcttatgaggaaaatttcattattactctatgtattacatgaggaagctgaagattaaggaagtcaaccgtcaatagccatgtagctattaagtgggcctctgagattctagaacagatcaatctgactccagactcctttaccacacactgcattatttgataagaacgtaagggagttgcccagagcatctaatctcaaacctatctctattaattccaaagtcctttatttttccatgcccacattctcctctatattgaatcttgtagtggattttattaaatgaagtgtggattttccctctctaagaatgtctacagtgaagttatttaccacaagatggttttcatccagacagaggtatatctaacacgaataaatattttctgagcatttaccatctgccccacactacagtaacactgtcgagttcactgaaatgaacctgatggcttctgtgattccaggcagcaacatgtttctctaaatccaatgaaaataggaacttataacatcttcagcttacatatttactgttaacacgaagggggaaataaaatgatttcatttccctttcgctgtttgaggagcagtaaagcccagcttcttgactttgagtcatacaccttgaatggtaggttgggcaaactggtggtcaccttcaggtcccaacctgtagagcaacccaccttggaaagcctcatcattcagggaggtaagtgtgccaggctccacaaacctggacttgctggtgaaaagtctctccagccaagaacagcacagccaggaaagggtagtgggaggtagaaagcaagctcagagctggcaagtggacagaatgagtcacctctttgatgtggagtggttattccaaacacagcaaaggtgagcaagcatttccttcctctgactaccctaactacagcggcaacagccccttaatgtaggaaactgagtcacaggctaggaaggtttcagagatgcaggaggaaaattgctagactatactgtaataccaatcttactaagataaatttagtgtcagcctggtaaaatatcattctgccttatttgcataaactaattttcccttgtttccacaacctttcctcattgctccctattcttagtagggatgccagttaagaaatgtacacatagagcaagacctttcagcagaattaactctttaaaggaatcagtgaatgtgagtgaaaagaagactgggattgtcttattaagagaatgaaaacgccgtaaaaaaaaaaaggttgttaaacccactggtggttctgggagtggctggttctttcataagaacagtttggtatactgggtcatgctagaattcgcctgcctcagcctaaatggattgagtccatttgcagaaaacagaggaaaagtacgctgtttccactggtttcaacttggagcaggattgtctgttggtgtctcagcatggggccttcttcactctccctggaagcaaggcccagaaacataaaggctatgttttctagactccttgtaagtagtgctctgatttagggtcttctaacgagagacacttgcacgagaaggtggaagagaaggcactgttattgctctggagttagtgagcaggtacagggtcactggcagatagcagatctgaggttttgccagtgacttttgggggtctgcctgaaaatcacctacttaggtgcttcagacaactgagacaggtgatgaaggtcccctgcaactcctgccttacctgatttcctgaatacttgtggcagtttccctgattttcttgtcttacaatgttttgtaaaccctaaattaaatttcctgattgaatagctaaagaggtttctgttttagactaaaccctacttgtcacatacttcgaaggggcaaagaatatatccaaataattcacctttcataaattattaagaatctatttttatgtaagaattcatctttttcaaacgtttatattttcattatgtaccaattcttgtggcaatgacttacaaaatttactatggagtcatgaaatgtatttcatgcttctcatgacatctgttgtatattaacatatgttcatctatcctatgtccttgaagagtgctatatgtttggtctgttcttatgtcagagaacacaaaaatacacacacccacaacctgaattttagtttgtaaatttagtggctttgtctgaagcttttctgagcaaagagtagaaggagagagagaaatgacctgaattcttaagaatagcatccaaaattttgactcatataggccagagtaaaggggaaaggtgagtctttcagagaaaacataatcttcgtgaattaacttttttccttcacaaagatcaggcttaatctttgctccctcttgcctctctcatatttattttcatttcccaatcagcaaaggaaatatgcttaattttagacttaacctgaagctcaacattgtgggtaaggggacttgttctgagcagtttaaattctaaggcctcatgattattgaataaacactgaatgaaaatagagcgactaaaatatcatgagattaataagtttgacatgattgtgtacgctttagtttgcttatgtaggacattataactgaaagaaatgctctgcaattttgtggatgatgtcatttgattatttgactttcctagaaaggaataatttagatgttcactgcccaaactatatcatctctctttccttcagggtgtgctataagattttcagtgtaaataagatgtcaaaaattggaagcccaaaccacagaacaaagatggcttgcagattcatctatgtattcagtccttcatttaaaaaatcattaatgaagtttctactatatgccagcctctgttctaggcactggggacatagccatgagcaaaataaactaaaatctctgtcttcgagtagtttacattctattgttggaagagatagaaaacaaatccaataaataaaattcataatattagaggaagacaagtgtttttgaacaaaatcaagttgggaggaagtgtggggagaggatacgatttcaaatagggtggtcaaggaaggtctcactgaggtgaagacatttaataaaagacatgaaggagatgaaggaatgagctatgtggctatgtagggaaagggtgctcctgatgaggaaagtgctggtgcagtggccttgagacaggagagtgcactgcacagctcaggaacagctgggtcaatgtggtggtgacagagggagtgagagattggtaggaggcttgtaggaaggaggttagagaagtagcaaacacctgtttgtagccattatgaagacttgggaaatgtgttctgctaatccaaacacagtttaaaagtaatgtattttataacatctgatttctgatacccctaagatttggcattactacattgtacattaccacattatgacaacaaagctgagcagtagttgccccttgatatggtttcagggctttccagtacttcttttttttttttttaagacaagatcacactctgtcactcagactggagtgcaatggcacaatctcagctcactacaacctccgcctctcaggctcaagccatcctcccttctcagcctcttgagtacctgggactacaggtgcatgtcactacacctggctaattttcgtattttccatagagatagggtttcaccatgttgcccaggctggttttgaactcctgggctcaagcaatttgccgggctcaagcgatttgcctgcctcagcctctcaaagtgctgggattacaggcatgagccaccgtgcccggcctccagtgcttcctatttccgatattctcacacttggcctgctttattaggacctaaattgatttttgttttgtgtctttataaatgaggggtcaattggcagctgccttagtcgcttcacagccaaagcattgatggaatgactctaggccttgggagatacagtcctggcaagcggctccttttggctccctttggagtccacattgttctatgaatgaccacaagccacatgtattaatacatgacaaaatttgctgtctcatcacagcactacacatccaagtgtctgccatctgcgcactcaggaatacatgtggctctgggcccggacatcatcgactcagttgttttagtttcactttggacattcagagctgccttttgatatgaggtgaggtttttaaaacagtttgtttttgtattcagagttcagttttatttaacagataacattggggaatagagtttagttgtgtatccacgtatatgtgtgtggttgacatgaacaaggagagagagtaaaagaaagggtgtagtccatgatccaatcaaaataaaatatactgactctttcacatttgtggcacatttgatcctctgctaactaccaatatccaggatttgatctggactggttggaaaatccacaaggtctaaaaatgatcaaatgtcctctctatggatgattttcttttcttaaatatattacaaaatatatttatccacacctcatgactcagaagctattatattttcatcttcctgattctggtagccaacagttagggttgagtcagtcaaatgtttccaaaatgagttacagaatgtacacttaatcataataaatgtcattgtatacagcagacttgttctggggcagtaccaacttgtgcctgggacatttatgtatttcgagatgtttttaattaaatgaacatgagtaagaattacttttatagctaacctgacccataataagtctgctttaaagaataatatttagatcatagtttagaaaattcaagttgaaaacttcagagtaaatttaactcaaaagcatttaaggtgacaaagagacatggatatttaataatttctttaaaatgattcaggtggataacggattcaccctcaaatgactggctttgatacttctccccttgagtgagaaaaatgcttaaaagagcaggaactgcattttaaactggttgtaaaaggggttcctggtttgtttaggaattacggtttctccagctcagcaagagctgagccaccaaacttacagaaagagactccacagtgtaaaacactaaaataacaggttctcactgggtatgagtaaaagtaaaggtaattgcagctatggctacagtaaaagtaagcagaaaactgaacgtttagcaaatgaatacactgtaaattgtccatttgaaaaatgcaagacatatttgttacaattcagtgtccactgttgacttcctaggttggatttcgtgggagagagacccagagccagagatttgtgtactggaagtttattgtgggacttttgggagtaagacccaggagagagtgaaggaagaactggcagagaaagaagctgatctgcaattcagtagcaatgaaggccacagtcagtcctttggggagctctggagctgggatggcctttcagaattgtcctaaattgaggcaaggagctctctttggccaaaggcatttctgaggcagggacacatttgtaaaccttcaacagctaatgtggcagctggggcaataaatgtctcagtcatgaataggaaatttggggagggtattcagcatccactacagttaatatagtttcatccttcaaagacaagagaagctatggcagtcaaaatggtaaatgatgcatagacctcactggattaataccacatactatcacaggaaatagggtatgttgtgtaatttggatgccgaaaacctgagatcaaatttcagcttgatcatttattagctgcagacaagatgagctacataatttttagggcctattacaaaatgaaaatgtggagtcccttattaaaaaggtagaaaaagagtgccattaaaagtactaaaatgaaatcttttttcttcctttgacagaccatcttcagcttcttatggtgtttttatttgttatttaatgttctaaataaagaagattttaatttaaattattggcatgaattttatcatttcatcatatatctttatattgagcaataccagtttgaaatgcatatataagagcatttagtttgaatacacccatgtattttattcttaccagaacagtgaaaacactgcactacttcaactgttttatttcatttcttgatatagaacactcacattctgccaacactctctcctttcaacttatgaataaataaggaaagactttttaaaaagtgtgcattgccctatctttccttttccttctgtgttataattttcagcataaaggattggctcgtacagggaagtaacatgagtataaaagatttctttgtcgtttgtgttacttagcacactattgccctctttttgcatttaaagcaaattctggtttgaatagtaagcttgctcagtcatagatatgacacacttactttgtactgatttttggttttactgacctcacacattccacaacagaattctgtgctcatgggatgggaaagagcacacactatgtgtagcccatctgcttatgcatatgttcccttgtcccatctaacttcacttacaaaaaacaacttctatgcagctgcgcaggtgacatcactgacactgactatgaagttgactctagctaggggactttgtaaatcatccaatccctctgagcctcagtttcctaatctgcaaaattgggataattatacttagcgtgcaaatttaaacaattacctgagaacctaaagagacaatatatgtaaaatagttatacaaggggagaagaaaactaatgtatactgagcttctgagtcccacttcggctattccaaaatacttgcctcaagatcactccagacacactttatcccttgagcctttgtagatttcttagtcttaggaaataatttcagcctctctgagccccttcacctggtattactaactcattgtcaaattctacctttgatgtcacttaatttaacaaatgtgtattaagcacctaatatgtgccatgtggtatgctagggggcagaatggggttaaagttagcaaccattctcaagactggttaatttcccctctcctttgaacttacctctgtcatagcatgtatcacactatgttatattgcctgtttgtaggtctgcatcccaactatactgtctccttgatctccatcatagctgtagtacatacactgtgcctggtatgtagtagatactcactaaattttttttattggctgaatgaataccagccattattggaatgcaaggtaaagaggttgatcagcagttgaaaggatgacctggatgaggagagaggaatgaactgaagaaataaatttggataagaaataaatgtcttagcatataggctacagaagtcatggaaatagaggagactttccagggagggtatgtataaggaggaagaaacctgggatggagcctaagcaacatgtacatatcaggagagacataggcggaaggacctgggaagaagactaaatcagtgctcacggggaggtagatgaaggatcagaagaaggtgtgatatctgagaaattagatgaactcattgattttggtgattaaaagatgttatagatataataaaagtaatttcagtgttcaaaatgaagttgattaaagagtgaatatgatttcaggaggatgtcaaattaggttcattgcaccatttgcatgaagacagaaatatttagggtccttgataacagaacttgtatagaatcttaactattcttgtgacttcaatgggagaaattgcaaaaagcaaagaaaagtggaaaagaagaggtccttagaaatgttcaaacttgagggcaattgaaagaacagtctacaattagcaagagtaattaagaagtgataactggatctaagtagactgaagttcaacaaatgtgtcacctttaaagtaagcaataagttatgaaagagaggcaggaaggatggggtgttcatagaacagcttgctgtggaaggaaagcaggaggttgctaaaaggttcttcaaattcatagccaaggtaccctgatgagactgagggtctcacaagttcagtcattcttgaaaggaataggaaaggcttttagtagttaagtaggagaagaattggccagagatacgtcacagaattgacctgcggcattaagtgccacaggatagtggaaggctataacattgtaaacgcaataaacccactattgggtgatttcatccagcagcactcagcaggctgtgagtaggaacagaaaagaatgagccatttgattgatccaagtctggatgtttacacggtgtgtgtcagaaggacaagaggatgagatttgatagttctaataaaagagacttgaaaatgatcaatcatatagttcagtgtgagtaagaaagaaaatacgacaagaatggacttgtaaatagtaataacgagatatacaacacagaagttaatatttattgtgcttttatttaagccaggcagagtgctaccatctttttgtacgttacctaattgaatactttcaaccatcctgtgagatgggaactatcggtaatatataccactttgaaaatgaggacgctgagagttaggatgaataagcaacttagcagcttttttagctactaggtagtagagcttggacttgacttcaggtctttcagctccaaagttgttcaattaaggactataaatactaatgacagcaaagcaaagatgaagatgaaagcagaagctccctagatgaattggagattatgttgagtggactgaatgttagattttaagatatttcagaggtaagtagtccatccagaagatgaaaagacacagaaaagttggtgcttgaagggacttgtagggaaagatgctgttccccccggggaaggtggaccctgcctccaggcatggatattgaggaacatccaatcattttcaataaaataacatgtctaaattatatccaagtcacaatgctacactcaaattctcccttttccacaaagatatcttccctgattctcttttctggaaagaatttattcttcctttgaactcacataattccatctttgcctggatcatacaatagtattttgtttatttgtatatatatcttatttcccctgagccacatacccatgagtctgtttcatccgtaaattttctaaagcctctaagatagtttcttgcatgtgtaagatgatcaatttaaaagatgttgaaaagactaacaaaataaaacttcaaacattttttaacattcagatgggaattgggtttgatgcttctcttctgccaaaatatttttagtgtttttattagtttttattagtatttaaaaatactaaaagcatttttagtgtttttatgttccttgaatatttgagacccttttgaacagaatataaagttatatcgatttttaaataatactattgcatttctcaagtgaattttaaactaattatatattagagagatttcctaactgcaaggtgacagcattgcaaatatttctttcatataaacctataaaacaaaaacataggtttttttctgttggaatgtacctaccagtaatcacagctatattattacttcatattgactgactggcctaaacattggaagatagtactggcatttaaaaattattaaagcaatgtaaacaaatatgctgtaaactctgattttgatcggtgtttaatttattgagaaaaaaatgaaggtgagattttgacacatttcagtttattccacattaaaaagaaaagtaaaaccaagcttctgactttcataaaaattaattttcttctaaggaggaaacctatttatttgtgctgttactgatgaatttatatttaactattaaattattgttgtattataattctgagcatgtttctattgaatttaagaaaggccatttgagtttagtaaaacacctgcaaactcagatgagtgtgaaatgctggctgcatctgagcacatttaaaataatgtgtttattactcaattaaaatcccaagtaatatgctacttataaattagaacttataaaataaagcctaggttatgatgcaaaatcaaactgctgtatttagtgagtagaaatgtgaactttccaacatggtataaaaatcaaatatagttggggccgtaggcaggtgcctggccctccttcagtgcctcaagtgggctcctggaggtgaccctctgcagggggtaggggcacacagggagtcaccaggagcagcccgtgggtgttcaggtgcccaggagctccaggtcacacttttgggacagccccccactcctcacccggccttaggccatgcctggaggcagggtccaccttcccgggccgagggtctttactctcctctccatatcagggcaaagggcagtgtttgcccccaacccaatcccatttctgttccctcccttggaggaaggggcattgtggggatgggacggacagtccttcctcttgagtcaggaaagtgtatagaggaactatctagggctgagcacttgggcgaaatggggaaaatgagtataggaactggtttttggaagctttggtggcttgaaaggtggtctgtctctttgggggaaagaggagagggtctcccaccaccgtgtattgaggcatgatgacaagaaggtgtcacgtgctgctaggactgacctcttcagctccatttacagcctccccatggcctggaggggtggaggtctgtagaatgggaggactttgcctcctttcaggaaacagaccggctcctgggctgtctcaatgcctctggggctgtagactggctcctcccaagatcgcagccaaaattgtaggtgatgctgcaacgacagtgaataacagcactccagattttggtctagggggccataagagacagttggaagatggagatcaaccggagagcaagaagctggcttcccagggagactcaatcagttctcaacttggacccatccatcgtcccccaaggacttcaatgacagaagagtgcagggtcccagacggtgtggtgggcctgatctttggcagagggcgcgaacaaattgacaaaatctaacaggattcagcctgcaaagtatagattactccaggcagcagtggcctacccaagcacagtgtgtccttgacaagagccccagaatctctccagaaagcgaagatgatgctggatgacattgtgtctcggggtcatggggggcccccaggacagttccacgacaccgccaaagggggccagaatggcactgtacaggacatgatccctgcgggcaacgccggcctggtcatcgccaagggcggggagaccatgaagcagctgcaggaatacgctggagtgaagatgatcttaattcaagatggttctcagaacacgaatgtggacaaccctctccggatccctggggatccttacaaagtgcagcaagcctgccagatggtgatggacatcctccgggaacgtgaccaaggcggctttggggactggaatgattacggatctcggactggcggggacattgatgtgccggtgcccaggcattctgtcggcgtggtcattggcctgagaggagagatgatcaagaagatccagaatgacgctggcgtgccgatacagttcaagcaagatgatgggacagggcccgagaagattgctcatataatggggtccccagacaggtgcgagcacgcagcccggatcatcaacgacctcctccagagcctcaggagtggtcccccaggccctccaaggggtccaggcatgcccccggggaggccgaggaagaggccaaggcaactggcggccccctggcggggagatgaccttctccatccccactcacaagcgccggctggtcatcggccgaggtggccagaacgtgaaagtcataaaccagcagactgtagccttcgtagagatctcctggcagctaccatccagtggggatcccaacttcaagtcgttcatcatccagggttcgccccagcagatccaacacgccgagcagcttatcgagggggcccttcaaccaggggccacctgggctcccccgcgtgcctgggggctccctccttaccagggctggggcaatacctacccacagtggcaaccgcctgctcctcacgatccaagcaaagcagctgcgtctaccgcggacgccaacgccacatgggccgcctactactcacattactaccagcagtccccgccccgtcgtcggccccgcgcaggtccccggggcttcacccgctcaaggtgagccccctcagtccccgcccaccggccagtcggactacactaaggcctgggaagagtattacaaaaagatcggcccagcagccccagcagccggaagcgcccggcagcaggactacacgaaggcctgggaggagcacttcaagaagcaggcgccaagtggccaccggagggagtccaggaactcccccaggctgccagccagactacaatgcagtctggggagaatattacagacagcaagccgcttactacggacagatcccaggtcccggcagccatgcatcagggacagcagcaggctcaatgaatggaatgaatgtgaacttcttcatctgtgaaaaatctttttttttttttcatttttttctgtttgggggcttcggttttgtttggcgagagagcgatggctgccgtgaggagtataggggagcccttgcggcaagcttgggggctcagggacttgggagcgtgccgggccctcactctctcgcccgttctgagtctcacatgctttttcttatatatatatatatatatatatatatatatttttttttttttaattatactttaagttctagggtacacctgcacaacgtgcaggcttgttacgtatgtatacatgtgccatgttggtgtgctgcacccattaactcgtcatttacattaggtatatctcctaatgctatccctcctccctccccccaccccacaacaggccccggtgtgtgatgttccctttcctgtgtccaagtgttctcattgttcaattcccacctatgagtgagaacatgctgtgtttgcttttttgctcttgcgatagtttgctgagaatgatggtttccagcttcatccatgtccctacaaaggacatgaactcataatgttttatggctgcataatattccatggtgtataagtgccacattttcttaatccagtctatcgttgttggacatttgggttggttccaagtctttgctattgtgagtagtgccataataaacatacctgtgcatgtgtctttacagcagcatgatttatattcctgtggatatatagcgagtaatgggatggctgggtcaaacgctatttctagttctagatccctgaggaatcaccacactgtcttccacaatggttgaactagtttacagtcccaccaacagcgtaaaagtgttcttatttctccacatcctctccagcacctgttgtttcctgactttttaatgattgccattctaactggtgtgagatgatatctcattgtggttttgatttgcatttctctgatggccattgatggtgaccattttttcatgtgtctgttggctgcataaatgtcttcttttgagaagtgtctgttcatatcctttgcccacttgttgatggggttgtttttttcttgtaaatttgtttgagttctttgtggattctggatattagccctttgtcagatgagtagattgcaaaaattttctcccattctgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctaggatttttatggttttaggtctaaaatttaagtctttaatccatctcgaattaattttggtataaggtgtaaggaagggatccagtttcggctttctacatatggttagccagttttcccagcaccatttgttaaatagggaatcctttccctatttcttgtttttgtcaggtttgtcaaagatcagatggttgtagatgtgtggcattacttctgagggctctgttctgttccattggtctctatctctgttttggtaccagtaccatgctgttttggtgactatagccttgtagcatagtttgaagtcaggtagcgtgatgcctccagctttgttcttttggcttaggattgacttggcaatgtgggctcttttttggttccatatgaactttaaagtagttttttccaattctgtgaagaaagtcattggtagcttgatggggatgcattgaatctataaattaccttgggcagtaaggccattttcacaatattgattctcctatccatgagcatggaatgttcttccatttgtttgtgtcctcttttatttcgttgagcagtggtttgtagttctcttttgtaagttggattcctaggtattttattctctttgaagcaattgtgaatgggagttcactcatgatttggctctctgtctgttattggtgtataagaatgcttgtgatttttgcacattgattttgtatcctgagactttgctgaagtcgcttgtcagcttaaggagattttgggctgagacgatggggttttctaaatatacaatcatgtcatctgcaaacagggacaatttgacttcctcttttcctaattgaataccctttatttctttctcctgcctgattgccctgaccagaacttccaacaccatgttgaataggagtggtaagagagggcatccctgtcttgtgccagttttcaaagggaatgcttccagtttttgcccattcagtgtgatattggctgtgggtttgtcataaataggtctttgtgcctgtagtcccagctactcaggaggctgaggctggaggatcgcttgagtccaggagttctgggctgtagtgtgctatgcgtatcgggtgtccgcactaagtttggcatcaatatggtgacctcctgggagcggggaccaccaggttgcctaaggaggggtgaactggcccaggtcggaaacggagcaggtcgaaactcccatgctgatcacatgctttttctttcaaaattgggatccttcaggttgagccagccagagaagatagcgaggtgtaaatctctccaaaaaagaaaccttacaaattaaaaaaaaaaaacaaaaacaaatagcaaagcagaagttattaagttatatatctatatataaaaaatatttttaaaaggtaaatcatttgtctcatgacctagaatgaaactagcacaataattacaaataattttgtttgtctatatacaaaattttagattggtgccattttatgaacaatactgcacttttatagttattttgtgcaattttatagtaatagatatttctaggttctctggtgttcttgtacgtgttgatttcttgttctacaaactacgtatttgtaaaagtggggtagagattttaatttgtatgtatatataaaagtctctattctccacccctcggcattcctgaacctgcctctctgaggataaagcaattcattttctcccacccttagcccacttcttgcttttaaaataaacttctaaaaagcaaaaaaaaaaaaaaaatcaaacacagttaacattgattttattttctactttgacaactcaagttttcatttccaagcatggcaatcatgttattgtgctgaggttgccataagaaaataccacagactggatggcttaaacagcaatttattttctcacagttctgaagaccgagaagttcaaaatcatggtgctggccgattcagtttctggtaagggctgtcttcctggcttgctgaggctgccttctcactgtatccccacatggtagaaagagagagctctggtgtctcttccttttcttgcaagggcaccagttctactgaattatggccccatgcttgcagcctcatttaacttttatcactaccttataggccctagctccaaatactatactatcacactgggagctgggcttcaacatataaatttggggaggatacaaacatttagtccataacaacaattattttaatttattaaattaggtagctcttctactaatttgcctagctattggcctgtttaagttgttctcaaatagattatataacttttaagaacataccaatgcctagggcccactttgagaaatttcgatttaactgatttgagatcaagcctggacattagcatttttgttcttgctgctgttgtctttgttattgatgagctgctcatttggaaaaaaaagtgactttatgtactttattcagtcatctatatccgaaatgtatctgagttacccaatgcatatattttaattgaggcaaaatttatacacaatgaaatctaaagattaatataattaaatgaattttgataaatatatagacccatatgaatattatccaaacaagatacagaatatttctatcaccacagaaatctctataatttcctcctccaagaaacccccttccttctgagcaatcatatttctgatttttctcaccataaattaatttttacctattcttgaaatcatataagtggcactatgcagtatgtactcttttgtgtctagtttcattttgataatttagattcatctatattgttgcattcttatttgttctctttaattgctatctagtactttattgtatgaatatatcattatttgtatatccattatctgcattgtttccagtttgcagccattatgaataagttagtataaacttttttgcgcatgttgttttatgggcacacttacttgtttttcttgggtaaataccatggagtggaactgctagactatagggcagatgaaggtttaaaagaaactgccaaatacttttccaaaacatctgtgtcattttacactttcagcagtaatgtatgaaagatccagttgctccatgttgttttgttcactgtcatggtggctctttaattttcaccattttagctggtatgaaatggtatcactgtggctttcatttggatttatcttttcatgtgcttattggtcatgcatgcatcctctattttataatattcaagtcttttgcctattcttttaaaattagggtttttatctttttattattcattcaaaacagttttatatgctctggataaaaatcctttgcatttcaaacgttttttcccagtctggcctttacttttcattttcttaatgtatcagcttttagaaaaacttgccagatgcagtcagagaactattactttctgccacatttcaggcccatatttctcttcttttctccagtccttctagataagaattaacattgtttgacaaatttgtttcatacatgctcactcatttaataagttgacaattgtgttgaatttgggtcactttctatttgacccttttgtctcaattttggtacaagctagagctgaaacttgagtaaagcatggcatattctggatggtatactagattacagtccagttggatgttaaatgaatccaaatgttatcacttcttattttaataaattgctttcaataaaaaattccccaaaatctagagtcaatcttttccctcaaatgatctcacatttaaccactacgcagtggatcacacaataaacaccatttggattctactgtaaattgtcttctaggtatattattacacaatcataatgtcttctaggtatattgttatactttataacaaataaatttgttttaaaatacttcatttggctatttttgacagaaaaatttcatcagaaattttttgtgactttatgataactgaaaattgcagaatacataatttttttacatgttagcatgatagcatgttaaattaaatgaggccatcggtttcaaataatgaaatcacattaaatttaatggaagccaacagttgtgtccatacttatgacagaatgattgtggaaacgttattactttcattcaaatattcaggacatcctcaattcttccttctccctcaaactcctgaggctactagctaccaggttatgccaatgatcccttcaggatttccctctaattttgtccccagtgtcctattccctctgccatttatttcattgctcccgatcatttctcaccgtggctcttgcaaaaaccatctaacttgtcatccacacaccaggcagtcccctttactgtctgaaacactgccagaatgatcttcctaaaaaaaaaaaaaaaaaaaaccaaccaaacaaaaaaaaaaaaccctgctcaagttgcccccttagtaggttccaaaggctccctcatatcactaagactccaaaattcctcagcatggcaaccaagccctgttatagattagccctctaaatttcttggcaccacattcatctcctgcatatcataccacatacctttcactccaggcacaccaagttgtcacttttccttccgtacttttacacaagtttgtaccgctttccgacatccacttgccttcattacacctgcagtaagcttagctccttccaaatgcagaacaaagaccacctccttgcttaagaattctccacttcttgctcctcaggtgtcataacaagaagattatgtgtaaaagcacaatgcagactgatttctacaaaaaaaagtgagacattaaagatttaaaaaattgataggattacaaggtaatagttaagagtttggaatcatagctgagttttagatccaatttcttagacatagctgtgttatttcaggaaagttactcatgtttattgcctcagtctcctcatttgtgaagtaaaagtatttccaccataaaagatacgtgtgaggattttttaaaatcacgtatacagaagagtttagcacagtacctagaatataataaatattctacaaacgatagccattgtcattcttattgctattgatcgattaaatggttgcatgtggaatgaaagaaaagtatctaaaggttaggtattgtagagagagaaaataacttttctgattagctttgggaaaaatagaaggggataggtattaattcatgagaatgtggattacaaattaaaatctctactccatttttgcaaatacgtagtttgtagaacaagaaatcaacatgtataagaaaaccagagaacctagaaatatctattactataaaattgcacaaaataaccataaaagtgcagtattgttcgtaaaacagcaccaatctaaaattctgtatgtagacaaacaaaattatttgtaattattgtactagtttcattctaggtcatgagacaaatgatttacctttttaaaaaatattatgtttagagtgctactaacaaccaatgttgtatccaaagagtcttcagtgttctggggtgaagaggataaaacagaaattacccactgcaatatttaaattgcttggtcttgtggcttgtattaaaaaataatgcaaatttttttcatcaatacattggtatgtgtttgaatataaaaatatttttatttaacatgtaataaacattgctaatctacgaagatgggctatgttcctcacttatcccaggaacgctgttaaaaatctttgatttgggataaatcaacatttttagctccagataaaaacaatgataaaatagtttattaaaattttccacttctttcaatgatcttaagttcatactcataaaaatattataaggtcatcacacaagataactgttcaatttgatttttttaatcagtcaaaattgctttcatgtattagatataaaaatattcaatataaaacataacttagtggttagcttatagttttcagttttgagtcagttttggtctaagaaataatagtaataacaataatgaatatttccttataagcataaatgtaatttttaaaaatttcctgtgaataatacttgattaatttcatttccctgcatatgcaagttccacggagccatgaatatgcccatattactctagatagaaatgagtctaatggctttgtctaaaacaatagactaacaataaacaattatatgtaatatagataaattagtctttgctttacagaggaatctgctatagcatttccaatatgttctcctactaatgattcttaacctttttgaaattataaatccctttgcgatctaattaaaagctctgaaattttctttccagaaaataacacttatatttgcacataaaccacattttgagtatagtcttatgaactcctggagtatgaagtttgctccatgaatcccaagtcaagaagcacttccctagtgtatttagaatttagtttaactgtctttgaaatccaatttccaaatcactttttaggggcacaaatagtataaaatggccagctccatcagagaaatgcaaatcaaaaccacaatgagataccatctcacaccaggtagaatggcaatcattaaaaaatgtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctgtaaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaaggacaaaaaaacaaacaccgcatgttctcactcataggtgggaattgaacaatgagaacacatggacacaggaaggggaacatcacactctggggacttttgtggggtggggggaggggggaaggatagcattgggagatatacctaatgctagatgacgagttagtgggtgcagcgcaccagcatggcacatgtatacatatgtaacaaacctgtacattgtgtacatgtaccctaaaacttaaagtataataataaaaaaaagaattcattaaataaaaaaaaagagaaaaaataaaaagtaaaaaaataaaataaaataaaatggccggctatctctaacaaaaatacagattcttttggaagttaagagacctcttggtgcctaacacaagctttataataggcttcgtagatgctggagactcagtgaagcctgtgtatccggttggcttcagcaggactgcctgctgctggggttgccttggaaagtcatcctcagctcaccccaacttctgcccttcctttacctgggataacatttcgcctaaataacaaccaagtgagaaatatcttttgtttgcactcttttcctttttattcacactgcgaaaatctttagcaggtatgatttgatgaatgcttctctctatgatatttttgctttctgaatctgtaacttagtgatagccttgtgttacatgtcaaaagcattatttatgcatttatttaacaaatacttactgagctcctactttatccctagcacagtgctataatggggggttccagtgagtaaaatcagagtccctaccctcatggggcagacagtctattgagagagatacacagtaatcaaaaagaatatcacaaataattacaagaatcatagtgctacagaggagagttacatggagctatgaaaggatataattgccctgtcggacaagtcaggaggtcaaaaaaggaattgaatatgctgaaatttgaagaaagagttaaccaggtggaatggaaaggagtagaaaagcattcctatacaaaagcctgtgtcctgactagcttttgccttactctgtgctcagatatttgcgtcttgctagaatagcctgtacaaaggccctatgcctagagagcgaactagttacaggtacagctgtagttcatataatttttgctactatgtactttttcaatcacagacttaggacctcaaggtgccccttagactggaattgctcctctccttctgtgtctagatgtggaggaatatgtttagctggaaggaagagcagtggatctcagcatgagaagagctgcccaccagaagctgtgtgcttctggacaaaccacacaattactaacttctcaggtcttgttttcattgggagaatccgtacaggaacattttagcaaatagctttttgaggtagttgtaaagagacttacaaagtatagtggatataggtggtggtgataatgtctgtggtggaggtggtatttctcttttaaatcagcttttctaaaactgagtcctgctcaatgttcggcataaaataattaaatggcaaccacaggcttctgttgttgagaggggctagacatggcgaggaggtttttaactttaaggcaaggtatatgagtctgtacaagaaagcagccatgtgttggctttcaaatacaacacaaagccagtgtgtgtgttgaaggagaggagtggtctttaaaagtctcctccttcacaatatgcacaggagggtactggtctacagagaaaaggcggcctccaaagacaacatagtttacagcacagaaagttcaggtaagagcgctaggtgggaatttgtaaaacatttcaaaaggaagcaaaatttttggaggtgtcaagtaaggaacaatgaagatgttatactttgtgcaagtttaatattttagccaagatttcagcaagaaaaatgtctgagcacggaccaaataaagtaaggagaaagcaagtcaggacacaaagaggatccttgctggaccagcatagcatcttttccccagaggcaaggagtggcatcatcctagcttcttttttttttttctttttttctttttttttttttttttgagacagtctcactctgttgcccaggctggaatgcagtggcacgatctccactaactgcaacctccgcctcctgggttcaagtgattctcctgcctcagcctcccaagtagctgggattttggggcacaccaccacacccaattaatttttgtatttttcgtagagatggggtttcaccatgttggccaggctagtctcgaactcctgacctcagctgatctacccaccttggcatcccaaagtgctgagattacagatgtgagccaccgcatctggccctagcatcatctttagaggcgaggagtggagtgtcacctcagcagccagcttatgctcttcttagtgtgcagaacgcatacaaagagtaaacattaccctgacctcatctgagaatagatggaggttcagatattctcagcaagtccttttttgcctttatgaattctcgtgtaaaagaaatttttacaaagagatacttccacttggtaaatccttcctgattattatccaagactttggtgtggagattaaacataatcagctaaggaaccaccctaaccgaattctgccttgatttctatttggtcacctatgtcttaacttatattacttcttgttaaattttaatgttcccaaacaaacttctgaagtcaattatctatttacagccaatgagagtgggaacattttgacagagccagctacttccaatatttattgatacattgcttcctacctgggacccagtattacttacctcactcacagatgtggttaacatgtacatagcctactggtctatgttacactgtttcacgttccagctgaacaatactcccctttaagaagcatcagagaacccaaattactgcatgatacctgactcaacttgttcctctattgtagcataagattaaagcattttttcatcgacttctcccctaacccccagtccttcttaatcctctatctggctgattcataacagctgttaaataactagacatttaggtaaaggcaaactgaagctataaatcaatgtgtgtgatttaataaccaactctttctggcgcagcttgctcatactgtcttggtttgcttttttttatgctgacttaagctgcagcatctgtatgaaggggtttagcacaattgtaaatactaatctccaggctgccaatgtcattacggaagtagatacaagtaaatgaaactcacagtacatttctatagacactgtgggtgattttgaagacatatgtatcttccaagctgttacaatcttcctgaatgtgagtatttcttaggactgtcttcgttgtaaactacagaaaccagcatcagctagtttaagcagaataggggaattagaaggatacagaatgtcctaaatgtcttacagaatccagctgcagggatgcagtggggcctcaggaaggggctgacaccagagcctagaaagccatcgagattttctcaccattttacctctcttcctctcagtccatctgttcattcctcttgctgtctatcaactggtttcttccacgtggcaggcattggctggttgttcagcaaattccttttttttcttctggggatgtaactagaccacatgggccattagatgtaaccacgtagctcacttctggcttccacttcaaattctgacctataagctcccatgaaattctgtactttctatctctcctaatctaccggcagaatgatgaaaactaaagccttggaggaggttaggagccacaggataaaaggagcttggtccctgaataactgcatgccccctgccctatcatcaacacctccctcctccaccatggacttgatgttactgagaagtaaagtgctatctgttaagttctacctattccgttaagctattaagatttgaagatttatcttctattgcagttagtatcactctaaatcttctttccttgtgtggaaaatacggagcctgtggcttcagagcttatgctttacaaatacagccttctaccaacaagaaaaaaaaaaaagccttctctcaattggtctcaattccaaattttcaaaaatcagagtcggattgaaccagtgggtcaactcctacccttgatacactcaactttgataagggaggttaagtcgtcatgcacaaagtggccactagagggtacactatgtgaacatgagttttaaaaccaagactgagccttgagttcttgttttggctctgcggctaacttgttgagtagtcttaatgattgcacttaaccactttaggcatcagtctcctcatatcaaaatgagaaatttagatgaagtcctttccaaaatgtttttctactttactattatataatccataagatttcatactatgctcagaaaacgacccttacacaacaaaatcagagtttcccagaattttttttgcagtttagcacagcaatgctcaaagtatcacagcactttttgtgatttcccaaataacttgcttagtgtcctaagatcataggaatgaataaggttaccattctaaaagttaatcgtgtgttctttgtgaagtacactaatggcttcttctgctgaactttcttaagaatttcataattttgggattatataatcctagattatactatacataattatatactatgcattgattaagagcacagattccagagctggattgcctgggtagatcttaagtctaccttctactaactgtgggataatatttactttagagagttattgtggggattttttttaaatcatacatatatggctctagcacctaagtgttcaataaatgtttgcttaaaagaagaatttcatttattctattgtagttgtttaagtatctgtctacaccaataaactttgagcccctaaaagccagatacccagttttactgaatttcttgtcattcagactctagcctagagtttaagcacatatctacttaataaataactttaaatgagtaaatgaataaattaatggtattctcatggagcattgagtttgccttacaaaaatacaaaataatctgtatttttctcattttaagttccttcaattagttacttttttttacagatatttcttcgtaggccggaggagcattcctttatgaacagccttaaggtatggccattcttctactgcaagattgatagcatgaggctacagattagcattacttggggagctgaggagctctttaaatattctgatgcctgggtcccacccagatctaataagttagaatcttagtggtgggggtagggcgtatgcctcaggatatttttaatgctcccctgggcagcagtcaggcttgagaacctctattctggcttatctgtttattttgctgtgatatattaagtgtatgtttctttcattattgtaacttagatttttttaccctttcacttgctcatcacagcccattaggcattgtattactcagagttctccagagaagcagaaccaacaggatgtgtgtgcttgcgtgtgtgggggggggatatctatgtgtgtgtgttcatgtgtgtgtaggcatgtgtgtgtctgaaccaacaggatctgtaccacatcctgttagtacacatatcttcatacatataagaagaaagacttactttaaggaattggctcacacagttgtggaggcttggtaaatccaaaatctgcaagggtagaccaacaggctggagatccagggaagagttgcagtttgagtgcaaaggcaggctgctggcagagttcccttttattctgaggagttcagtctttttctactaaggccctaacctgattgaatgagtttcacccacataatgaacggtaatttgctttactcaaattctactaatttaaatgtaaatatcatctaaaaaaccattacagaaaaatctagaataatgtttgataaaatacctgggtgctgtgtgacctagccaacttgacacatacacacacatcacaagcacttgggacctcaatttttgccatttcctctgcttaaaaatgttttccagtagctccatgtatgcttcaacagggtttgctttatgataatctccttcctgtggtggggattatgactgctctcctaacagaagcaggagagacaaacctgacgtgggagggttaaaagtctgactcaaaggcgcactgtcacaatagcctggggaaggttctgcatggctgcctttgtctgcaagagtgctcttgtttcacactcatctccctgtgaatgtctcttagaagactcagctactaagtcaaatgaatgtacacattcatctcttcttatgggaattacatccaggaaatcttgattaaaaccagatcaaaactgccaatgtaaccaagagattctcctctgaatgtagacacaataactgtcaacacacaattgtacttttcaaaaatgatgattccaaaatttgaatctaatcagagttccaaataaaaagtttacatggtgttttccttgcttgaatgaatgaaaatctattttagaatccaaatacttgtacaaaccttacctatgattccaaaattgaaattattttggaaaagtataattgttaagcaatagtttttaatctagattgagcagtcagaatgtcagaggatctgtagccccagaattattggaaatgtgctcaattcacttggccccaagcatttaaaaataggctttgtataagaagtctgtaaaacaaatttcgtggccaacatactttcataacaaaagctcaaactagaatagtgtttagactgaattgaggttttaaaatagtcaaaaatttttggttaatctctcttgaatctgttagataatctttataattttcaaattgaggtacatgatctctgattaaactgaatgctatatagattgattaattctatgaaattctgacatctttgaataataacttctggcttatgtattcgtatgttaaactatgcatcatttttataattgagctaaattaccagtaacatatgactaacaatcccacttattaaaaggataattgctagcttcaaaattaatactactatcccaatctagggaccaagtgctgctaatgttacagtggcatagaatgcctcccctaaactaaaaggatcacactttctgctgactgactaaaaatttactttaaaaattgagtcataaccctttttaacaaaataaaacgtttgtagggcatatctttagctcaaagtaaactaaaattaggcacaatttcaaaactgtcatcagattttttagggtggggagcaagttggtagattaggaaactactgactccccttaagagtattggaaactacctggctggaaatataaaactacttacatcaggttttctcatactgccttagagttgtagaagatttacatggtggaggagtatagcataagttctcaagcaatgtgtcaagatcacttgcaaggtacatgacaaatcgttaatatgacaagagtgaaaaatattaagctataagatttgtaaaactgtttcctctctccccctctgcccctacttctaaagagaaaggcttcttgcttcctgaatcagtactttgaatccctgcccgtttgttttacagaatgcaggtaaagaggagacttaaaaattactagaaggaagacaagcaaaactgatctacagtctaaagagctaagccagaaagcagaagggagagggataaaaatttaattagagtgggcttgtgagagttgttgagggaaatatgaaaagagagatagttggaggcatctggggatattttggaaaaactaaaatagagatgaggaacaaggatttattttaatgatatttcctgtgcattatgaatgcagggtctttttagcatttcaagataaatgaactaaagaataaattgcttcccaatcattttgaatcccagactgatgtttctctgaatgtgattctttgcagagaaagaaccactgagaggctaagctttaattaggttagatcactaacaataaaaatttacatatttttaataaatcagagtaaccttacttttattcagttgcactctgctatgtttccataagtaggaagaaaaaggtaaaattaaagctctcttgccagaaatgacacagcccataatggcagctggtattcatgtattgttattaattgtggcagtttcaatctattggttacaaaacaaactattagaagtaagagaagcaaaggggggaggggggagggatagcattgggagagatacctaatgctagatgacgagttagtgggtgcggcgcaccagcatgtcacatgtatacatatgtaactaacctgcacattgtgcacatgtaccctaaaacttaaagtataataataaaaaaaaatgtaatctgctttgttagtctgttctatcattgatataaagaaatagttgagccagacttggtggctcatgcctataatcccagcactttgggaggccaaagtgggtggatcatttgaggccaggagttcaagcctagcctgggcaacatggcaaaaccctatctctgctaaaaatacaaaaattagccgggtgtggtggtgcatgcctgtaatcccagctactagggaagctgaggcatgagaatcgcttgaacccaggaagtagaggttgcagtgagccaagatcatgccattgcactccagcctgggtgacagaacgagactccatctccaaaaatctaactaaaaaccttgagactggataatttataaagaaaggcagtttaattggttcacagttctgcaggttccacaggaagcatgatggcatctgcttgcttctgggaggcctcaggaaacctacgatcatgaagaaaggcaaaggtggagtaggcacttcacatggccaaaacatgagcaagaaagtgagggggaagtaccacatatttttaaacaatcaggtctcatgaaaattcactcatgtgagacctggttgttttaacgtgaggacagtatcaaagggatcgtactaaaccattcaccagaactccacccccttgattcaatcatctcctaccaggcttcatctccaacattggggattatatttcaatagagattttggtggggacatgcatccaaactatatcattctgcccctgatacctcccaaacctcatgtccttctcacatttcaaaatacaatcatgcctccccaataatcccccaaagtcttaactcattccagcatttactcaaaagcccaaagtctgaagtctgatctgagacaaggcaattcctttccacctgtgagcctgtaaaatataaaacaagttaattacttccaagatacagtgggggtacgagcattgggtaaacattccaactccaaaaggaagacattggccaaaagaaaggggctataggccctagcaagtctgaaacccagaagggaagtcattaaatcttaaactccaaaataatctccttttacttcatgttccacatccagggcacacttctgcaaggggtgggctctcaaagcattgggcagctctgcctctgtagcattacatgattcagtccccacaactgctctcatgggcttgtgttaagtgcctggaacttttccaggcacagagtgcaagctcttggtggatctactattctggggtttggaggacagtggccctcttctcacagctctgctaggctgtgccctagtgcggactctgggaaggggctctaacctcacctttccccactgcactgccttaacagagtttctccatacgggttccatccctgcagcaggcttcggcctagacaccgtggcttttccatacattttctgaaatctaggtggaggctcccaagcctcaactcttgcattctgcacagttgtaggcttaacaccacgtggaagctgccaagaattatagcttgcactttctgaaacagcagcttgagctgtatctgagcccctttgaaccatgactggaacaggaacagcagaaatgcagggagcagtgtcccaacactgtgcagggcagtggggccctgggattggcccatgaagccattcttccctcttaagcctctgggcctgtgatgcaatgaactgtttcttagatctctgaaatgcctttgagatatttttctcattatcttatctatcagcacttgccttattttcagttatgcaaatctctctagcaagtggttcctccacagcctgcttgaattcctctcccaaaagaaaatgtttttttctctgtaacatgtttaggctgaaaatttttcaaacttttatgctgtttccctttaaaatgtaagtttcaacttgaggtcatttcttttctcctgcacataggaatagattgttagaaacagccgtgtcacttcttgaacactttatcgcttagaaatttctcctgccagataccctaggtcatcactctcaaattaaaacttccacgtatccctagggcatggacacaagccagacaagctctttcctaaggcataacatgcatgacctttgcaccagttcccaataagtttctcatttccatctgagacctggtcagcctggccttcactgtccatatcattatcagcattttgatcacaaccatttaaccagtctctaagaagttgcaaactttctctcatcttcctgtcttcttctgagccctccaaactattccagcctctacccattacccagttccaaagtcacttccacactttcgggtatctttatagcaatgttctactccttagtaccaattttctgtattaggccattttttttttcgctataaagaaatatctgagattagtaatttataagaaaagaggtttaattggtttatggttctgcaggctatacaggaagcatggtagcacatgcttcttgggaggccacaggaagcttttactcatggcagaaagcaaagtgggagcaagcacttcacatggcaaaagcaggagcaagagagcaaggagagagtactgccctcacaatggttagtgagttctcacaagatctgttcatttaaaagtgtaaggcactgccccccttgctctcttgcttctgctttggccctgtgaagtgcctgttccctctttgtcttctgccatgggtaaaagttccctggggcctccccagaagcagatgcagtcaatgcctcctgtacagcctacagaaccataagccaattaacctcttttcatataaattacccagtcttaggtatttctttacaccaatgcaagaatggcccagtacaccccaccaagtttgaatcaggaagaaatagaaatcctgaacagaccaataatgggtggtgacattgaatcagtaataaaaaatattccaacaacaaacaaaaaagccatggaccagatggattcacagccaatttctaccagactttcaagaaagaactgacaccagtcctactgaaactattccaaaaggtttagaaggagggcatcctccctaactcattctaaaagccagaatcacctggataccaatgccaggaaatgacacaataaaaaaagaaagctacagaccaatatctctgatgaacatagatgcaaaaatcctcaacaaaatgccatcaaaccaaatctaacagcacatcaataaaataactcatcatgattaagtgggtttcattctaggaattcaaggatgttgcaaaatacctaggaatatatttaaccaaggagatgaatgattgccacaagatgaaagaaattgtagatgacacaaacaaatggaaaaacatcccatgctcatggattggaagaatcagtattgtgaaaataactatactgcccaaagcaatctatagattcaatgcaattcctatccaaataccattgtaatttttcacagaattagaaaaacaaattctaaaattcatatggaaccgtgaaagagccctaatagccaaaacaatcctaagcaaaaagaacaaatctgggggcatcacattacctgacttcaaatgatactacaaagccataataaccaaaacagcatagtactggtgtaaaagtagacacatagaccaatggaacagaataaagaacccagaaataaagccaaatatttacaatcagctgatcgtcagcaaagcagacaaaaacacgcatcagggaaaggacacctattcagtcaatggtgctgcaataattgaatagccacatgcagaaaaatgaaactggatctctatcaatcaccatatacaaaaattaactcaagatggattaaagacctaaatgtaagacctgaaatcatgaaaaattctagaagaaaacctaggaaaaactcttctgggcattggcctaagcaaagaatttatgacgaagaccccaatagcaaatgcaacaaaaccaaaaataaacaaatgagacttaaactaaaaagcttccacacagaaaagaaataattagcagagtaaatagacaacctacagaaagggagaaaatattcgtcaactatacatccaacaaaggactattattcagaatgtacaaggaactcaaatgagcaagaataaagaaatattctcgttacaaagcaggcaaatgacgcgaacaggtatttttcaaaacaagacatacaaatggccaaaaaacatatgaaaaaatgctcaatatcactaatcatcagagaaatgcaaattacaaacacagttagataccacattactcctgtcggaatggccattattaaaaagtcaaaaaaacaacagatgttgtcacagattcagtgaaaagagaacttatacaccattggtgggaatgtaaattgtcagaacctctatggaaaacagtatggagatttgtcaaataactaaaagtagatttgccatttgatccagcaatcctacttctgggtatctacccaaaggaaaaaagtcattatatcaaagacacctgtacaattcacagttgcaaagatataaaatctacctaagtgcccaacagccaattagtggatacagaaaatattacatacacacaccaaggactactactcagccataaaaagaatgaaataatgtcttttgcaacaactgggatgaaactggaggccattaacctaaatgaagtaactcaggaacagaaaaccaaatatcatatgttctcatttataagtgggagctaagctatgggtatgcaggggcatacacagtagtataatggacactggagaatcagaagtggagagagtgtgatgggggagagggatggaatattacctattggttgcaatgtacactattcaggtgatgggcacactaaaagcccagaattcaccactgtacaattcatccatgtaaccaaaaaccactcatacccctaaatctattgaaattttaaaataaaataaaaaatgttaccttcatattgttttctatcttattgacggaattttaacacagctggtattagagttggggtagaactcagaattttttattaaaaaaagtattataacgactatactatcactaatataaaaaatcaacaaaaacttagtaccgttaacatttccttcattatcttttgaccagctactcagatatgttataggaaaataattttcatggtagacaaattttttatcaaccagttaaactgccatcagtattttctatatcaattaataactacattatttgattaaacaccagaattctcattccttagtattcaaaatgtgtttcatggaccagcggtacagatgtcacctgggagcttgctagaaatgcagaatctcagattttgcccagctctactgaatcagaatctgcatttaacatcatgcaatgtgatttgtataacattatagcttttgaagcactattctaattcacagaatttcttcaagtgaaccagtgactatctgtaatagaatcatctagaatgtttgccaaatatgcatttcctagatcccacctgagatctaataggtcctttgaatccaagtttttaaaataatattctgtgtgattgtgatgcatattaaagcatgatgaacaaggttctgtgcacttttgtgtttcaatatttttacccgtctgctgctttatttatatttagctctaagcccataatcacatggttattgagtttgctgtacttaattgtgtttgttgcatttccttcgtttctgttattacctcatcatgacttcttaggctattcaatgcatagatgggctcattacacttggaaaacctttttgggctatccttacaggcttttcctgtcttcctatatttctattcaatgattagagaaggttgaaagtggatgaaaactatgttgccagggctttttatatcttgaatgtaaaagtccttcccaaagagccaccaggaaacctctctctagctgtttccttggaggtcttttacagaaaatgcttcttaaatttacttccaaaatataatttaaattcataacagaatgctaaagactttcagcctagtttaggaaaaagggcaatgcaagaaaaactacaataattacttccagtgccttctctaccattagctattggccttgggcagattttgtaacctgtctgagtctccttgcctcatttgtgaaatgaggataatgatacctgccagaaggttaggcattgctccagattgtcccttggtaacccttccagctctgacatccatgattccattattctgtcaagtcaacatatatttgtgtttccatacgcctggcttctttcttttcctctccaatttgtcatctccttgcaatcacacatgcacacttctctcttataactatttctataatcacacatgcaaactcctcccttataactatttctagtgaaaatgaatttagaacattttattggagaaatttactttcaccataagtgtaaaatatacttatatttaagataagtagcctgccacaattaaaccccatgtgtctattaattatctcgttaagtggatgcagatgaaataaatgggtgtggataaagacccatacttgagatatttaatagtagccacttaatttaactacccactgagctcatctaaaatgcatgacaataaaatggtaaagtagagcctcacaggtttcacttgcagtgagaacaattcagcaaatatcactagtgaataagaaatcggtaaaattcaatgagctactggaacatgcaagctgaacagatagttcctttaaatatctgtatatgaaaaatgatctgatctcatatacatttgctgagttaattagaatgaaaaaaaaaccctctgaagtctgttttcatagcctcttacatttcccaaagtagagtaaaagaaggaaaaagcgcttgttaaactacagtaaggcttgtctaagtgaccacttgtactttgaagaattcttgttaaacattccctgaacgctgcacttaagcagctgctacggtactatgcttataaaagactttgttatacttgtttcttgctatgtatcatgactgcatgatatacttattaagagcagaagcactggaatcagacagacctgcatgtgaatcctggcttaccagctacgtaacgtggggcaaatataagttttgtcatctgcaatgacactaataacaccttccttaggagaatattgaggattaaataaaataatgtatataagacatgcatttgtccattcttttgttccacaaatgtttactctgccatctatatgccaggcattatgtgagtgctcaatatttagcagggcatcagctagaccagcccctaccttcattgagatgacattctggtagactgacacatctgcctgttgcatagtaatcactactgttactgtaattgttgttttattcctaaatgtatattactttaatccaaaattaaacattaaaaatactattaaatattttaaaggcacaacaataaataagtaccttgcccatgttgacatctcccatatccacgtgcagctcttctgaactcagctcttatgcgaaggaactaaccctgagctagccaagcaggacggacattccatcaaaaggaataatttaaaatgagctttaagttcgacttgtattgaaattgcctaaaacagcagtataggatgatgcttaagaacatgaactctgttgccatttgattgggtttgaattcaaactctgatacttgctagcttaatgactttgagtaagttacttaatctatttccacctcaattttctcatatgtaatataggaatattgatagttcctaccccaaagagttgttgtaaatattaaattacatgaattaactcatttaatatttacaacaactctttgaggtaggaactatcattattcctgacttactgttttataggttgcgtagacttaagaatgcctacacattaatgttacatatataccatggaatactatgcagccataaaaaaggatgattcctgtcctttgcagggacgtggatgaagctggaaaccatcattctcagcaaactatagcaaggacaaaaaaaccaaacaccacatgttctcactcacaggtgggaattgaacaatgagaacgcttggacacaggaaggggaacatcacaaaccggggcctgttgtgggatgggaggagggggagagatagcactaggagatatacctaatgtaaatgacaagttactgggtgcagcacaccaacatggcacatatatacatatgtaacaaacctgcacgttgtgcacatgtaccctagaacttaaagtataaaaaaaaagaatgcctacacattgttaacattattacgtgtataatgctaattatatgtattatatgtgttaaatgtacagttgtacatataattgtataacatataaatgtataattatacatatatacatgtgtaatatacatcatatataatgcatatataatatatacttaatataaatgtatatattatatataatatatgtatatatacacattatatataaaatgtgtatatacattatatattatatattatacaatgtataatattaatgttagagataaagaaaacattaataatgagaatttaactttaaaaagtatgtcatgcctgtaatggttacattgttaaaaacataatttgaaaatattctttcgatagtcaagaattagattcagcaaagaagtcactgacataatttattaaccaataaggtgaggaggctctgacttacatcttcattacttcagtttcatcttgctaactaatgtaaatgaaaatattaaccaacattcatgttggaatttgttataggactgatggtttagagaaagctacttaggtgaaggacagaaacatttttgtgggaagatggcaatgtcaccagtactcattaggtggagcagcagtgtcatcatcccccaaaagcattttatccagaaaccattcaataattttgctttgtcgctctttgacagtccagaaacaacaataatctggaaagtgggggcactgttcttaaggagtttgtactgggggctcataagacattctgtttctccctctccataacccctttccaggtcgagttaaatttcctttattatcctgagtttataaggctaggtcaacttttctgtaatacttttttccatttgaggaaattatactttggattcaataatatatacccacaagggagagaatatggatttaaaaataaacttaaaaatataacttagaatattcagtctggaggggacctgagagattgtctgatccattgcagtattgaccagattcacattgtactttcataatgtgcttttattgtcaggaagattaatggacatcaggtgtttataacactcttttctcttagttgtgcttaaaattttctttataaaagatattaaaagaaagctaacaaaatattatttatatagagagagcatattaaattgttcttagcaccatctacactaacgagtctttggacagataactatcagcctgatttgaagttgaaatgtattgattattaatattgtggaaaagtctgtgttttcatagcttcaaaccattttagcacaagttggaaggatttacaacattgtctccatctcttaccatctcatctgatcaaactttgttcacttctttctcacccagatatctcatcctgttactttaatgctcaaatttcagaaagagcagagcaaacctctcaaagtttgaacccataactattctaactcacagctctattgacggctgggttaactctggaaaaatttgtcactcatcttctttaatcttgtcatccatctacaaccaacactagcaacgttctcccattttaatggtctctcatacatttccagaactgataatatttctaggaaatgtgcagcaatgcctctcctaataaagcccccagctttcatttttatattaatataaggcaaaatgtttgtattctctcaacatatttcatagccctgaacccagacttttagttctacaggaaattacagttaatgttagcgattaggtctggtgctttcgaaagcatgttatacaggttattattaggcattttgatagaaaaaggactgctttactgcaagaattctgaaaaccttaatgtgctaacaaaattgtgatttcctagagggttaaagaacacagcattttccaaatgtgtgtgctcataggaactttttccctggaacaccctttgggatcagtattttatgaaatatgttttggtaactaataacatcctcaaataagatctagagagtagtagttacttgtccagaattcctcagatatatatggtagaacataggtatacagggtctatttggtagactagaacccttgagtaatcttttgcacacccaggtttttaatacttttatgtgggtccagtcacacccttttcttggttcttataataatcaatggaccatgtagacctagtgaccagtaagagtaaatgttactataatgtggaactttgtaaatggggctcagtacaagggacctctaattttgttaaaatagaagataaaaggagggccctaatatgtcccaggcaaaagatacaacaaatagcaataacacatcattcaacaaattttgttgagcatttatcatatgccaggcactgtgttaggccctaagtttaaaaccgtgaacaaattaaacacagttcctggcatcatggaatttactgtctaatgagagatacccactagtgaatatgcaacaatgcaatataggtataggttgaagtgaaagcacaaatgagggacaactaacccagacttgaaagggagaaggttgaatactacttcacaatgatgttcaagatgactcctaaaaggtgagaaggacttaggtgaaggtgaaaggggctcaacaaaaagggctctaaactaaaagaacatcttcaaaggccctaagattaaagagaaggtcgggtggggagtctgtaatcccaacactttggaaggctgaggcgggaggattatttgaggtcaggagttccagaacagcctgaccaacatggtgaaaccccggctctactgaaaatacaaaaactcaccagatgtggagatgggggggtgcctataatctcagctactcaggagcctgaggcaggagaatcgcttgaacccgggaggcagaggttgcagtgacatcacagcactgcactccattctgagtgacagcaagactctgtctcaagaaaaaaaaaaaaagatgagagagagagagaacattgatatgcttgaggaacggagagtgtctgaggtagaaagggtgggaggtgaggctggagtgataatgctgctggtagagatttggggtgctgaagtgatgggatggggaaccactggcctgttttaaggagaggagttctgcgttgaaaggtctactggggtgctgactggagaaccgataagaacagaaaaaaacgggtggaaggctattgtagttatcttaggaagacataatgatgtcctatgctaaggaagtagtagtgtggatagggagaagtgagaagagtgtgaggtgaactagcagaacttggtggttgacacgttgagagaggtgaaacgaagcaagtaaaggataaactagagatgacagaccactcatagagtaagaacgccagtgggaagagaacatttgaagaaggacaaataacaatatattaacagataggttaagaggagacttttatgatcatatttcttaagttagcattccatataaaccaaatgcaaaatgtatatgcaaaatgtgtcatattgtcatactactgttacacataaacataatggtagatacttcctttgatataagttagtaaaatttgaaaacaatatttgctcctttcagaaatttttagattatttctaatcctcaactaatgggcattatcctggctttcttggtattaaatatatattttgattaaataaaagaaaaactaaatctatagttatcaggcagaaacaaatataaattgtgagctatagacggactaaattttctgactttttaaaggcattgtgtgttgttttatacttccagattgccttatgcacctcttaagatctttttcttacagttggtataaaccctccatgtgggaagacctacaattatagcagctggtgtttatagcaagtaacaaggctgaattaaacaactattatctccattttggaatggtttgttaaaacaatgaaatcctttcaagaaagtactacatgttggccaggtgcagtggcttatgcctgcaatcccagcactttgggaggcttgaggagggccgatcacttgaggtcaggagttcgagaccagcctggccaacatggtggaaccctgtctctactaaaaatccaaaaattagccgggtagtagtggcatgtgcctgtaatcccagctactcaggaggctgaggcaggagaattgcttgagcctgggaggtggaggttgccatgagctgagatcccaccactgcactccagtctgggcaacggagtgagaccctgtctcaaacaaacaaactccagaaagtactgcatcttaaatgatgcccaagtagtactaattttgtttttgttttcgttttttctttcgagatggagtctcgctctgtggcccaggctggagtgcagtggctatctccgctcactgcaacctcggcctccagggttgaagcaattttcctgcttcagcttcccacgtagctggggttacagacgtgccaccatgccaggctaattatttgtatttttagtagagatggggttttgagagaaaggactagctggatttcctaggcggactaagaatccctaagcctagctgggaaggtgactgcatccacctgtaaacacggggcttgcaacttagctcacacctgaccaatcaggtaggaaagagatctcactaaaatgctaattaggcaaaaacaggaggtaaaaaaaaatagccaatcgtctattgactgagagcacagcaggagggacaatgattaggatataaacccaggcatttgagccggcaacagctaccctctttgggtcccctccctttttatgggagctatgttttcactctattagatcttgaaacagcactctcttctagtccatgtttgttactccagctgagctttggctcactgtccaccactgctgtttgccgcctccgcagaccaccactgacttccatcccttcagatccggcagggtgtcctctgtgctcctgacccagccaggcgcccattgccgctcacgataggtctaaaggcttgccattgttcctgcaaggctaagtgcccaggttcgtcctaatagagctgaacactagtcactgggttccatggttctcttccgtgacccacagcttctaatagagctatgacactcacctcatgacccaagattccattccttgaaatccgtgaggccaagaaccccaggtcagagaacatgaggcttgccaccatcttggaagtggcccacagccattttggaagcggccgtccaccatcttgggagctctgggagcaaggactgcctcacaccactccccgtaacagtttcaccatgttggccaggctggtcttgaactcctgacctcaagtgatccgcctgcctcagcctcccaaagtgctgggattataggcatgagccaccgtgcctggctattttgggaatcgaaactagcaacatgaaaaagtgacccctaaaagtgacttaaaaattaaaacacactttgggaggccgaggtgggtagatcacgaggtcaggaggtcgagacaatcctggctaagagggcaaaaccctgtctttactaaaaaatacaaaaaattggctaggcatggtggctcacacctgtaatcccagcactttgggaggccgaggcgggcggatcacgaggtcaggagttcgagaccatcctggctaacatggtgaaaccccgtctctactaaaaacacaaaaaattagccgggaggctaccaggaggctaaggcaggagaatggcgtcaatctgggaggtggagttgcagtgagctgaaatcatgccagtgcactccagcctgggcaacagagcgagactccgtctcaaaaaaaaaaaaaaaaattaaaacagctcatagcaacgcatattctgaaaataaatttgatttggcagaactatcacgaattctcacataagaactctgataaattcctagcgttgaaaaatcaataagaacttttaccctccatattgaaggaaggataccaaaaaacaatagaaatctattttaaaaaagaaaacgcatatccaagtttgaagaactgctttttgtgttttacttatctatccccattttgtcttaagtagcatcttacaatatttgttactttctttaaatgaaagtggtgggaaaaaaattaaagaaaggaattctcattcacttcctcccggttttatgggaactacctttatatgtatttaaaatgtcattaaatggtgaagaaagtattttcctgatcagaacatttcagaagtgaagtgtacaagcacaaaatgccaaatgccatgaggctttatatcagcagccataggaaatttcttgctcctctcgcactatggagtatgcatagcttgtccactcacatttacaatgagttggcagttaaaacttaactatgagtttgaagacatggaagagcattcaaagcagccaagaatagaggatgcagagggactcaaaattcattgtggtgagtctacgtttgctgctactttttcctcttgggcatttgttgattcacagctcagtgcgccaaagccagggaaagtcatgttttaaactctgtggcagtctcaccgtgggggacatcaaaacttagacttcatgactacaaagattagtcattactgaaggaactaagaaaagtgagcccaacatttggcacaaattttatttctaaagcatttgttaatccctaagctatgcgttggtgataggagacaaaagaaatgaagttcttaccatgtcaaggaaataccgcttgatagatactccaggatttcacctaaaagccttaaaggcttagtccataggaataaagacaaattataaacctatcagttttcacaaattgtgaaatctagtttcaaatcaattagttccctaactgaaccaaggtatccagctagtactatattgtcctactaaaagaaaattaaattctctttggagaaaattaacatctccaacaatttttcatacacaatgttcaacattcgatccaagttgacaggtatgtctatacaaagaatcacattactgaagccaaaaagcaaaaataaacaatggaaatagatcaacaaataatacagatactgaagttatcaaacacagactttaaaacagctatgattaacattttcaagaaaacagatttaaaagtatataaaattttactagataactagaatctataataaaaggcaattcaaattatggactttaaaaatacaataaccatagttaaaattcaattcaagaaacaggtttaatgccatagacagcagaatgcagaagcaattgcctgaaacagagttcaatataaagtatcaaaattcatgtatagcaagacaaaaggaggaacaaaaaggagcataaaggatatctgagactgagagaaaagatcaacatatgtgtaatcgaaattcctaaaggagaagaaaaggaatgctgggcaaaaattttgcaaaactgatgaaagacaccagaaatgtaagtaattctttgtactccaagcaggataactacaacgaaagccatgcttacagacatcattatgatacaaaccactgaaagctaaaaacaaagagaaatcttaagaccactcagaggaaaatactattaccttcagaggaataacaaaagaccaacagctgactcttcaaatctttcaacagaaatgtcgaacaacagaaatgtcgaacaccagaagaaaataaaatgacattcttaaaatgctaaaagaaaataattgccaacttataatttttcatctaggacaactgaggacaaaataaaaatgtctggacaaataaaaaaggaattttattgccactactgaaatattatctttaatggagttctttaagcagaaggaaaattactccagatggaaggttaatcatacaagaagatacaaagagcacaagaaaaaataaataggtaggtaaaccgaaatgaatattaactgtaaaaaatagataaaatgatttcaaactacaacttgcagattgaaacacactgcccatgcagacttttatgccatagtttagttgttgggctatgatggagataagcacaggatactatgtgaggacaacaagggcacctggacaccttggagacacaggaaagatcttcctgagaaagtaacagatatatatctatgatctctggttactcccctttgtaagttatttgctcctggcaaattgaatagtccacagtttcttacacgtattctgccatttctttactcatgatgtttgcgtattctgttttctctaaaatgcaaacatcctctccatctcacctcccaatgtccatagattcaaatctttcaggtttaaagctctgtgccgctatcattttaagccttctctggccatgttccaccaccatccctggcaccccaacccaaaattcaagaatctttttcttttttataaggaatgtatgtttatgttatcattcctattaggatttaggttcttcaggaacattttgtcttattcaccattgtttaccctccaataaacatctgttgaataacgaatcaatggatggatggatagatggccagatagatggggaggccattaggacaatcctccaggtaagtataaattttgctctgacttggcacttgcttaactataaatcaaggctcaacatgccattttctctccattcctgcatttttctggttttaatcacacagttgctgaatcatcaaatgctacagcagaaacatatccaaactggtaaaattctcagtaactatttttgatcttgaagccagttagaaacatactattaagggaaaagtgataacttgttaatattatggtttgatgaaggggaaatattgaacagagttttctaatatatttaactggtttataatttgcagagtaaaacttcaacaagtgcatgcccttgaaatccattaatctctctgtattgttttatgtctgaatcagtacagagagaataaacaatatccatagtaaaatgaaaacaaaatatcaagtttttctttgtggaatgcacaggcctgcataaagatagatgaattttataaaactaatctatgttcagtcatggacagataaaaactgccaccaacaccagcaacttattttatatatatatatatatatattttattatactttaagttctagggtacatgtgcacaacgtgcaggtttgttacatatgtatatatgtgccatgttggtgtgctgcacccattaactcatcatttacattaggtatatctcctaatgctatccctcccccctccccccaccccacaataggcccctgtgtgtgatgttccccttcctgtgtccaagtgttctcaatgttcaattcccacctatgagtgagaacatgtggtgtttggttttttgtccttgcgacagtttgctgagactgatggtttccagcttcatccatgtccctacaaaggacatgaagtcatccttttttatggctgcatagtattccatgaggtatatgtgccacattttcttaatccagtctatcattgttggacatttgggttggttccaagtctttgctattgtgaatagtgccgcaataaacatacgtgtgcatgtgtctttatagcagcatgatttataatcctttgggtgtatacccagtaatgggatggctggatcaaatagtgcttctagttctagatccctgaggaatcgccacactgtcttccacaatggttgaactagtttacagtcccaccaacagtgtaaaagtgttcctgtttctccacatcctctccagcacctgttgtttcctgactttttaatgatcgccattctaactggtgtgagatggtatctcattttgaacaccagcaatttaaaagagaaacactgcctgaacttgcacgtgcacagtgaaacaaacctccttaatggaacgcatgtaagattttcaatgtttttctggtaaatattcaagcaggtgatctaagcaggtcaaaattctcagaagtgagtcttgattttctaattgagggaatttagaaagatgtgttttggcatatgtgcaacgagtaaattttctgtactccttagaagaaaagttaaacaggattaataacatatcccattaagtttcttgggtagacccaactacacgcctacctagtatctattctccatttcttaaattaatgattttcttggagatctcaatgtgctcagcttaaaacagaacaaaacaaaaagaaaacacatgcatttcataatctttcttgcagctaaggataggtcatgtgacacaggtctggccaatgaatgtaagcagaaatcaagtgcacacttctgacatttttttttcttggaataaacactactgtcttcttctttcccccgtctgaaaaatatagacacaattactaaagctggagtttcaacagccatcagctaactataaggaaagtaccaagaacattgcagaaatctctgttctgatctcccaaggtataaagcaaatgctaatatagcacacgactggacttactatgtgaggaaaataaatgtgtttttcaaaccaaaactttaaagattttagttacatttacctgaaatttaatctcagaataaataattcctcaagaacatcaaccaaaccatttcttatctttttcttctcccaacttcctaacatacacggttttctcaacaaaataggaatgaattaataagtgattgaatgaattaagcaaccattccactatttatagcaatatctatttgaaatttctagaaaaaaagcaaagttaaatcctatgtcaggtaaacctacttgaattcaaaataaactactgaacattgtgagtcacagaatacatattaagatattttaaaagtggtcactattctaagatctgtcagtgagatatagacctctatgatagacagcctccttcatgaagaagaggcattaaagttttgaaatcagatctgttataattaactgcttttctgtaatcacctaggccagaaatggaaaggaagttaacatgagcatggagaaaatcagcagaatcaatcttaggataatggagaatgtagaggcagaggaaatacagtgagggaattaaagttcagcccttccttcctcaagaaggtctccgaacaatatacaaagattgacagataaggaaatgaagtgtatctccttgtctgttcaagaacttgtgtcaaggacccctgactgcactggtcaattttagatttcagagaagtctaaacttttgaaaagtagctctgcattatggaaaaattggactcctctacactctgctacttgaagagcagctcctggacgagcagcgttagcatcaactggaaacgtgaagtgcagagtcttgggtcccatctcagactattgaatcaaattattcttttgtatattgaattttgagatgtactgtactagaaaaccttattaaatattgtctctttgatatctgagtagttatttgactatacttctctaagttccagatgtcaaataattttttagaatgtctctcacaacttttccacacaatttcataaaatgaatattttaaaaatatactcttgaaagaaattgataatgaaaaaaaggtgagcccccatttttccctggagattgggaagacatgtgccattcactaaaaattacatttactaaatctagaaactggatcctttgccaatgtgatatactttctttcgttttctgtttaagggtgaggttttgactgtgtcatttaagggcctatgaagtccttggaaatttggtcttctctcccttttaccaatgtactttcacttgtaggcaagctctaaatgaatggcatgaggaagagcagatgacttgactagaaggcagatgatttattttccttgagtttaccatcattttcagacattcttaaggaaaatgaattatacatacgttaggatattggaattctctttgctgacaaggcctatcccaggaatgatacaactgtgagtaaagttattgtctctacattgcttcaaagaaacatgtcagggtaggaccaggatggttaatttaccaagggcttgcttctccagttcacagatgtgtatattctttggaagtagtggttgcagttttaaacactacatcccagatgtgcagacaagatacaacttctttattttctctgtaacctatcatattttccttacgaccagggatggggacactatactttagttcaacttcataaatatagtctgattcaataaatagtctatttggtaattgtttaatcttttttaggtgaaaggctcagtccttcagattccatctacccctgcccagctcctccccaagaagacctttggatgaataggaaagatatggggtttacatgacctcatgataccctgggcgagcagtgctcttgaagtcacactttgtgttgtcctctcttttctctgctgatgcatggctgttctggactgctctccctttccaaatagtccctctctcagtcacatctaactatgactgagtgatttagcttcaccatggatcacactgatactgcagacccctctaagactgtggcatgttcttcatttctatcttggcctaggctacccaacccagtcacttgatgccttgcctcaaagctcagtggtaactcactgcccacaaatcagattccttcagcatctgcaaggaacatgcagtcatccctgacttcttcatctgccttccttgctaccttcagccaatgaagtgtggcattttccttggccttgaaggaagtaggtgccaccaaggtagaattctacaaagccagtttggaggatggtggagtagaaagactgcaagagccttgtattctgtcttcttgctctttttctctcttctcctccaacatctctagaaatagagggtgcagatttctggcttttcaatttccctacaccagtgctacccagactagtgccaggccatggactgtcactggcccacaataagatacacacaaaaatcaagagtaaatttctagatacaatttaacagggtaatttcatatctaccaaatgtaatttaaaatgttaggcttttattttatgtgtctttgtttttctatttcatttttctcataactcacttttattgtattttttaaatgatagtgtgggagcccagggaaaacttcctcttcaacctctaaagaagcagtccccaacttttctggcaccagggaccagtttcatgaaagccaatgtttccacaaaggggggctgggggttggtttcaggatgaaactgttccagctcagatcatcaggcattagattctcgtaaggagtgtaacctagattcctcacatgtgcagttcacaatagggttcgtgctcctatgagaatctgatgtcatcactgatctgacaggaggcagagctcaggcgttaatgctcgctagcccgctgctcacctcctgctgtgcagcccggttcctaacaggccatgaagtagtacccgtctgtggcccaggggttggggcccctgctgtaaagttttgcttaaaaaaatcaactgacaaaaggcagattaatcggtgaaaaggcatacagatttattaacatgtacacggagagaaccacagagtgactcctacaacccctcaatgggatgcaaaagcttatttaccatcttgaggttacagaaagaatgaaggctcagagcatggccaaaaaggttatggtggtaaatcaggatttactggcaagacaggtaagagggagaggagagacttggctggcaaagatggtcatgttacctaggtgaaacctcacaggtaatatccctccaaaagaataaatggtaaatatttctttcagacctttaaaggtgtcaggctcccattaatctttcctagatccagtcaagggaaggtttcagagaaagcctggatgcatcaatgtaaattttctctttagatgcaaatctccacaaaagagctttgcaaggctacttccgtttgcaggccctctgaacagccgtctcaaaatatgtgaaagaagtgtctatgggagtgaaatatttttacttctttcaatagaacaagatgtgttagaaactttttaaaagtggtttctcccacagatagtttgagaggcactgctcctcattgcatctgctctctattcagcaagcctaaggaagaggatcattgatggaagggacatcctctctgtcctgctctctgcaccacagaagaaacataaggagttcaccagacttgagtctgggtatgctacaaaaatgtgacttcttttcctgacaaagcctggattttgaacttattttcaagttgtagatgcaagctaaaatctaatttgacagtcaaagctggacaaggactcccctgtgttctggtggggactatgttctgacaccttttccctgaagcacggaaacccattgtttcaatgagtgggaagtcctaaagcaatgtgatctacaggataagaagacacaccaaaaaaaatatcctgaagttgctgatgtaagaaggatggttggagaacagctctatttcaagaacatctgaatatgatgtttttcataatcttaaaaaaacctgtatcggtaatcaatacaatacattccaagtgaccctatttttttgcaaaagaagaagaaaatctctagaaaaccatttgcattcatataagctttacaatgcctgaaacaaatgtttaggcctcagtcttttccagttcaaagaccaatgaaaataatttgtagaccacacttgaacaaccacaaattgagtgctgttcctaaaggaagctttcgcagctgggatgcctgaaacaattctggcattaagtgggtgaatattattattaataatatttaattaagtttctacctgagcaccctgctgaaagactctctaaaaactagtctaacatcattaatctaacaaaataagggccaaattaggaaacagaagaaggctacagttttatcattgtactgacctatcttagaggtaacgttgactctccttagagatagtttccaaaatactattactcagttgaagaaaagttagaccatgctcaagaataattgttttgagattgtcttatgccccacaacctccctgcaagtgccattttgctatgttccttaaaaccacctctttttcaaggattcaattcccttaagtctgcctgccagcctttgtctcaactcaactcaaaatggcaaggatatgacttggtttatctacccaagttgatggataaccaattagactttagtgtgactgtatatgcttctatacacactctatatacttctcaagaagtatttgtagtgtttgcctttgatctataattgtagcttgaaagctctttttttcctattcagtagacttcagataactgcaagccataggcagtctctctcatttgaaaagagaaaatcttttcttcaaggacaatatctggtctccccaacccagatggtccctgcttcctgagcagacctattttgtttgttgttgttttgagacagggtctctctctgttgacgaggctagagtgcggtggtgtgatcatggctcactgctgtgttgacctcccaggcttaagcaatcctcccacctcagcctcctgagtagcggggaccacaggcatgtaccatcacacttggaaattatttttatttttattagagacagggtctccccatgtggcccaagctgatctctaactcctgagctcaagtgatcctcctgccttggcttcccaaagagctgggattacagatgtgagccaccatgcctagcttctattaataatgtcagtaagaaggtattgcccttctccaccagctcctaaaattaggtagggctgtggccttcttgcctttgaagatgacattcccaatcacagttaatatattaaaatatattcacatagattaaatatagtatatgtaattatattgactaaattctcctacacttgatgctttgatatattgtcaaattttgtagacatttgtttcatttggtagctttatttattttacttattttaatgtatttatttatttcagtgtggtagttttcttattttgatgccaatttgtttttagctgtctaatatttttattagttgtcttgggtcaggtttcctagaagcaaaacctgacatgaagattcatgaacaagtggtttattacagaaggattcctaggagaaaatgataaggatttgaaagaagtagtggggaagtcagggcaagactgggaaggggaagaacccaagcaaggctgtaattgcagataaagttgcaatctcagcctaatcctatggggagctctagagtataaatcacatggcaagctttgtcccacttgttgaggcaaataagtcaggcttttgtacccttccatcagtcaatcaccagctgtcagtcagtggataggaatattctcaggcacttccctcagtgatgagacagtttatatatccaaagacagtcctctgcagaggcaagggagcctttagcaaaagagaatacggacgctgaggggacagggcatagtgctggggaaaggaattggagagggaagcacctgggcaggacagagtgttcactacagcagtcattgaaaagatcataagcaccatgcctggagcaccgaaaagatgaaataagccttgaaatccagatggtttctggcatatcacaggtctgctagacttttcttttctctcctctaacccaatgctatcttttactcccccttttcatcctttgccaaagactttctgaaaattgtttgtaatatctggtacacctaaagaatctgttaggtcctcagtattaaacagaagagataagtgttttcacatcctatctgataaaatgaaggacacaaatttaaaaatgattgtctatttttaatgttataatttcatatttacctctctcattcttggatttgttcttactcaataatagcttccaacattgtaacctggagttgttctcactctcttactaaatgatttgaatccaattccaagaataatgctgccaccctatttataatacacttgcacctccaattgattcctttcacagtgcaatcctcaggtacagatgtaaagttttctacttcataatgtaaaagaatgtaagagactatctcatgacaggaagaagactctacagaaaaacctttttttgaaaccccatagcccagacagtagcacgttatttttggtgaagaattatctgaaaatataaatggtatcttaatcagtgttcaatggagaaccaagaagggaaagaggaaggagtaaactttgaggagagtctcttttcactgattttgtttaggattgcaagtacctagtgtttatgaaaagcaactggcttttagtgggttctaattctcagcaggcaattcatccccttattccttgcaccccaggcagatcacttctactgctaccattcctctccacttcggtttgcttttgggtgatgtagtttgtcctaagaccagtgagttccatgagtattatcacattgccactccttttgctgtaaaataagttccttggataaaagccctatgaagaaggatatgatggcagtgaataaggcacactgtcatccaggaatagtggtctgggcaaaggcactgcaagcgtggaaagcaaatttgaatttggaatacatctctgttccacgtggacacatctttgccttctccaggtggccagctatttttcccaggaatcatattctatcaggggctcattgctggcctctgtgctacagcaatggtcatagccagatcagcgttgttgatgtgctgtggctgagctcgtacatacccttatttgtgacgttataaaagtcttctcttgattcctgatgtaagttttcagttcaaggccctaaacttattgttttcttttaataagctctctaacacagtcaggcacagttgacacactgtgtctataacctttgtaaccaccattgttgcatagcaatcagatgccacctttatgtgatcactcaaaaccttgctctccatcacctaaaaccatcaccaatgataattttagaaatcgtggcactgctacctgtcacccattaacagggtgcgatttctgtctagcaaggagtttattcatgtgtccataaaacatatgagccactctagtttcagaatcttctccagaatgtctgtttcatgaggctactcttggtaccaactactgtatcaggcagggtcttaacaagagaacgtgggcacacagcagggcagaaaaggtggataatggagccagaggacaggcgggccaatatacaggatgcttaacaagggcaagtaatcaaaaactcatttatattaatatttctataaaagaattcctattggttttgtcattcttccttaggtatatatgcatgactcttcctaaccttttcttctcttattccacaattctagctcttggctttccatccatatcacaccaatttgatttaatacctggctccactactagactaatagcccagtagagtgagcactgcagaagccttcagtgttagcacccatgaccatagcaaactgtgtgcctaccagctatttatttgagttttcaggacaacctctacaagatacctaatcctctatttttcttaaaattgttggattttttttcagcatgtgggatgttgcttggcctaaacatgatgaggcatggcataatgagtgtcaggaaggtcaggaaaatgtaggggggatatttgtcaaggaaaagaaaacaaataactttctgccagatctttcattccagacatgctggaaactcacaccatcataggcttgggtagtcaaagcaaactttaagtagtgctaagaaacctttgacatgtgtgaattggcagtccatgttgcttctgattcagcataatttattaagctttttggcatgtctgttaggagttatgaagcacaaaaactcatgcctcttttaaaagagaaaaggtcctattcagtgattgtgacaatttacaacaggatcaagaaggctggcacttagcagtcgtgggacatagctggcagctcaggaccttgtggtgggtagaatgcatagcacagatgtacccatgaaactaacatacagacttctgcttagggaaatcaccgttttacctacatcttactcacatgctattgcattgtcagggatggtttcttctcggtttctctagatctaaatcagatgcccagtgtttaataccacctttaaatcaatggtatcagtgaccagttgattgcttagtacaaaaatagttctccaaagacagagatatggctaaatctatttaaattttaaactcattatctttcatgatctgattaaagccattaacctaaccatccaactcataaatgcattgcagagatgggacaccagggtgcagatggactagcataatttctctcaaaagtgttcctgagtgtttgctgtcctgatctggaacaccacactgcaccttcccataccacaccatatcatattcagtcaatttgcttgctagtccaggggagatggcaggaagtttcttttaatctctggctttgttccaaaataaatattcacttgaggtgtcttaattgcagtgggaagtaactcttgtctgaaaggtattcaatttaacaggcatttgttgagagcctactatatgtccagcacaattctaggcactttggatacaacaatgaacataaacaaacaaaaaatccctgccctcatgaagcctacattccagaggaagaagaaagatgttttaaaaaatacttagaataggtcaagtatataaaatgatgaccagagtaatgaaaataaagtagaaaaaggagtgtcagggagacaggtagtggtcagttttaaataaggtggtgaaggaaaactttatagaaaagaagtcaacatttgagcaacaacctgaagaaggtgagggaaagggttgcatggagatcagggaggccagtgtagctggagcatagagaggagctcaaagagggaaagaggagccactgctttgttgaaattgactgcaaggaggcaaaggcagaggcagagaattcagtcaggagtcatcgcaatgacccaaaatgagagatgatggtggcttgggccagaagagaagcagcgaagtgacgagaaatggtcaaatttcaaatatattttcagctaaagctgacaggatacgctgatagataggtcatagcatggaggagaataagaggagtcaagctggatcctgatgcttttggaccgagaaattgtagactttaagtagaatcacctagcaaagaaaccaaggcagatacaagatggatttatacatttatgctcacatgcaaacagaaggtgacatgaggctattttcttacgtctttcatacatcagcatgaattaactactggagtgtgtcatttaaaggacaggatatggtctgcacacatttaagtctaacaacagtaaacattattcctgtatggttaattgggagttgacatcaccctcagtcagcctgtggttgagtcttgcagggaaaatgccactgagttttctcagccttaaaaaaataatgtatgcttttatctgacctaaagtcaggaactataaaagaagaaatgcaaacttggatgcatgagcagaaatgaaataatatagcaaattactttgaagttaaggatttagtgcaaaaataagtttatcctgttgtaaaattttagtcataaatatctttttttcagtgtgttttttttttcttccccacagttctcggcagttttttgctctcaaatgtgggcaaggtaacaaaaatttggcttaaaaatgtgggcaaaagttaacaaaatatgtcaattatgttattcttttttccccaacaattagccttatgctttccaaaaacaatcccaatgtttatctctatttccaaggaaatacaaatctctgagaatttcaaggatcgctattttgctttactgttctcatgtccttagtcagttccttgttgtaactatctggtacaacatttttgatatcatgtgaaagaggtatggaaaagtagaaaaaaccccagactgaagcaagtcagatttggaagtgtaaccatggggaagtgactagaacactttaagcctcaatttacataaaagatagtaatagataatattattggataattatggacaatgatacctggttgggttgttgtaaggctcaaattagttaacatgtacaaagcacctatgtaaaaatgtggaatttatatgaataattattactttcagcattttcagtagctatagaaacaaaacttcagtggacattgctaaatttttaaagaaatacaattttgagattagtccaaatttataaaaaaaattttactctatcataaaataaggcctagcttttaagaacaaatgagtagcattattccttttctcctgggtttttccccctcatttttaagacccacgcagggcatcacatatttcacaaatgtaatctgtccgtgctttatttcctagatcacaatgccaaacacaaaagtctagtcatcactaatcatttgatcaagcccttgagtttgacaatctcaaactatgttatcacacagaaaataagcagaagattccataacactaaagaaaaaagagtttctttaaaaactctattctcccctaatgaaagaaagaatgtggtggacattgtcctagcctgctaagcgtgcctgccttgtgtgtttccccagacagactcacctgcctcactgatcaaagggttgggcactgacaaactggtcacactccttccccagaatctttcaaaagttttaaaaattagtttgacggtatatttgagctgaatttgagggacagagctcacattcattgtgtagatcaatgacactcaaagcatggtcccaagccagcagcatcagcatcatctggaaacttattaaaaatgcaaatttgggggcatcaccctaaaccgaactgtgtgggaaattctggggacagagtccaggaatctatttttaaaaacctttcaggtgatgctggtgcacttaactttgtaaaccaccagtgcaaactaacccagatacataactctttcatcatatgaaatttctctattgaagaaaaataatggaacccgtggtatatccaaatatttgtagctctaccacaacaaagtcctctactacttgctcatacatatgatttattaaactacagaaggaaaatgtcttgaatgtacgctagtttctcattttaaagacctttagagttacagattaaaggataatcattttcttatgtctgaaacctccaactacccaattctcccttcataactgaactttttacagatttagatcttgcctatatttataactgctgcatacagtccaacaaacatactccacacaataagtttgaatctgaactcttgtgcaagtgtccctctgcactgtgacttttaatcaggaagttatgaaacagccatttttaataataatgctatgtgttagatgtgccaagagatgttgtaatctgtcaatgtgtttgttcctgtggcctcaagctcaaattttcagacagttaccaaatgagtgaagcaagctaaggatgagacagtaggcaatggtggggactatggcaagctggaatatgcctgcatgcatttaatccagagattctattcaaaaattgtgaaaacatggtgtaggccaagtgaaatgtcagttattggattcaagttataggctgtattatatgaactttggtttattcctactgcattcttgtagttgtgcacctttggacttagaagtaaactgatcccagaccaatcacagaagccacagaggactgctctatggaaaacaagtgtgttctttacttcactgcttcttacccaggtcagtcctatctaagaagcaggctcaaagtttaggggaaattttcttctttttgtggcagtctgattgagatataattcacataccctatactataagctgaattgtgtccctcccctcctcactccatcaaatttatatgctgaagtcctaagccccagtaactcagaatgtaaccgtatttggagatatggtctttacagaggtaattaagatagaatgaggttattatggtgttctaatccaatatgactactgtccttataaaaaaaggaaatttgaatacagatatgtatagagggaagacaatgtgaaggcaggaagaagacagacaatgacaagtcaaaaagaaaggcctggaactggtccttccctcataaccctcagaaggaaccaaccctgccaaaaccttgatctcaaagttctagcctcccattctgtgaaagaatacatttcagttttttaatccacccacagtctatggtacactttgttatggcagcccttgcaaatgaatatgccatacaagtcatccgtttaaagtgtctaattcagtagttttaggatattcacaaataggtgcaaccatcaccattagtcaattttagaacgttttcatcactcaagagaaaactctgtgcctttagctatcaacatcctatcaccccatcctccccagcactaatctagtttattttctttctagatttgcctattctggatgtttcatataaatggaatcatataacgtgtggtgtattcttggctttcttcattagcgtgattttaagattcctcattgttgtcctatgtattgttcaagaagtaatgcattccttttcaggcccaattacaactccattgtacgaatatcccacattttgtttatccattaatcagttaatggatatttgggttatctccacctcttggctataatgaacaacgttgctataaatattcatgtagaaaattactttataaagagaaaagctgtatgttttgaggagaagataaaacctgtactaacagaacatagtgatgaaaattcctcactatttttttaagttgacttctggcaaatttctacctttcttattttctctggggcccttccctcattctcactttaaacaagctatcaccatccacacttgcaggctgattcattacctatttgttcaacaattacatggcactgagtttactgaaggatatatgaggaccctcaggggagaaggaaagggtcattgtagatgtggcatcagatccattatgaagtttaggctgggaaaagacatgggcaaatgagtgggtgggtgtgggtgtaaagggttgaatttgtgttcagaagcataaaaagactccccagctgtggagggctggccaaattatgctcgatttgaatgtagtggtggaagagctgccagacaaagagaggtatttaagtgaggtaagtaaacctagcccactagttcattaggctgttcttcagtgctcacataaaggagtgatttacaggaactctattttacaattagttgtaatacgagccaataaagaatgggagagtggaaaagtcatggaaatcttgattgttacaaaattacatcatggagagcctgaaaaaagaagtttgtgtgtacattgatatagtaggttgccaagtcaatgtctaaactaagagtttctcccaattagtttggcatgggaaagtaatttttaaaataagggcattctcatagtaataatgtattggtggaagtgtacatagtgtgtctatggcagtattgtgaaaacaatagtttcatagtgttggatcagcaacttactatgtgccagatgtgacactagaagctggagatgctgttgtgaaataagataggcgtggtccctgccctcacattgtcccagaaaaaattatttcctgacttgtggttagtgaattgttcccgacatgcctattggaaattccagtcctatagaatgtggttagataagtagtgtttctcttatgcctttgaatattctgactcttaaatagtaatggaacaatctgagcacccatatgtacaaattacactaggcacagcaagttcaagaatcattaaaatatttggctcttgccttcaaagaaccaacaatgaaggatgtacatataccatatacataatgagagattctggaatagaggtataaaaaagtgagagcatggaagttactcattcttgcaaagagtatggttagttgtagtccagaggaaaagggttgggaagttttcacaggaaaaagtaagggttgagccagatcttcaagacttaaaaggatttaagtccaatagtaaaaggagcgaagggaattctagtaaaagggaacagcttgaggaatgacccagagacatgacagtgatctttggagaaatggcagttagacagacattctgtctactcgtttccctgttacatcccaaataggaaagactcagacccagagaccattctggttaaatgtttcagtgaaaagttaagactggtctatcggtcttaactatcatttgaacacctggaaaatctctaagcatataaaagcatgcatggctttctggggcttaccacaaattaaacttgaatttctataaaagcagatgacaggtttaataggtaaataatcttgacttataggatcccccatgtcaacactaagttgagaatcaagttaaggaagtacagtatgtcctttagcataattgacaggcagttctcagttttactgtggatgactttaacttgagtataaccaataatgctcttaccatggatttgtgtaagatggattactgcaggtcaagggcaaactatttacatctgatggaggcagcatagaatagtgataagttcctaaataaaattgtcttggttttaaaccccaactcttttacctgttaggcttaaccttcctgagtcatacaaagtcacttgacctcaattgtggataacaacggcccttgctctaaggggctattgtgaggattaaatagtacatgtagtgttcagcctggtgcatgtacaacattggcatttgcaagctgttattataaagtaatggtgaagaatctgagcttcctagatcttatctagatctaaatcctgcctctgtcagatctttgaaaattttcttagtttctatgccttgattttattgtctaaaccaagagaaaatagcacagttactgcaaagattaaacaagaaagtatatataatatgattaccacaatacctagcacataggtcttcaaaaaggcagttcttgttaatattatataatttacaataagaaaaattttgtttcctcatagtcatattttctaagctttttaaaattaattttggggtaattttgaatacattattggtatctaataagaacctatggttggcccttttgtatagtaaatatacactgatgactattcatttgtattaaaattttcccgagtagcttctgcttgactaaagtatttcctcctttctattttaggatttagccttcatataattaatatctattaatatatgtgtttgctttagggaagtgttgggattggcttccctggaaagcagaccctgtgatgtatcaagaaatgtgaaaggtttatttactgggaggtgaaatgaaagaaaagaaggcaggattgggcagagatagccatcaaacctgttgcaggctgacaaggtctaggccgaagcggggctgtagagcaagatttgcttggtaatgttatcaagagcttggtggaaaaggctaagtccttgctaccactgccttgctcaatttttggccagagctatcctgagaagtataaaaccttggccgccaacaccttgcttattccagagttcccccagatgggttttccttttacttgagaactaagatggactgtgaaggtgatcatagctgatggccttcagctaatggagttcatcatagcagcaagtcccttcttgaagggacatctgaacagtgcgtgtctgtgtctgctacagaagatttcaggaggtaatggtagtaatggacctaatttagtacttacctagattttcttagcctcgccagtccctggactttagccactttcttaaagaagagtcccagccaccttcaacacccctgtacctcttaacactagcaactgtttcagctcccctgggatgagatataggttcatattcagcctttactgcactccccatggcagaaattgcagcagctctgatgctcatcccaggcagccaaacttacaaagtctttggttctttatacttctgagctctgatgaggctatgctacatctgaggacatgagatctggccaggtatcacaacctgctagaagtagaggagagttaatgttccatggactgaactttgataaatgagaaacagaagataagaaggattaagcagacaatatatatatcttctactcctttgtcctcaatggactgtccctgaatgcagtggttcagtatagcctacatagatgaagtcccacaagattaagcattcatctttgttttcttatgacattatggccagcttaaaaacatactaccttgcattttctttacttttatcccaacctcatttctcttttattcttctctcttgcttccctggaatcacagttgcaaataactgtcttatattttagcacacaagctgaggtttggctcatttccctgggacctagcctaagaaaacagttaacaattattcagtgcctactatgttcccagtgctgttctaggagctttaaatgtatcctttcattgtcttctccaaacaatccaatgacataggtattcttagtatcttcatttccgttttatagatgatatgagaaactagggcacagaaatgttgagcatctttcataggcttctacagctagtaattagcagatctaggatttgaacgcagacagtcttgactacagagctcaggccctattctgtttctgcagttgaatttaattctcaagtctatctctaagttaaatactcataaatgatgcaattccatggcaaaaatggaagttacatgtcatccaacggaagtactgctaagccagacataatgtgaaaaatgtttatctaaccagaaaagttgaaccaagtgaaggaatatcaaccagaggtgagatatttggaggaacaattcaaaggtctggattctctctggcttcctcagtttagttaaccatttaaatttggataaatcacatgatcattctatgcctcagtttccccagctactatatgaaaatacaattcctaagctgcctgtctctcattacttgtgtaagaactgaatacattatatctaggaaagcatttctaaatactaaattgttactattatcaccattagagtaattttgttaataaaaagcttacaaactttaatgttactaaaatttagatcaacttttacatctcaaaaaaaggacttttgaagacacgagacaaatataacatgaatttaagataattaactaaagtaaggcaaagggaaaagaaaagttgcaaagcaaacaggtaaggacaagatcagtgcatagcgtaaatgccatccttgctagcgatagaacacacattttgttctatgctttctggcagctgacacaaggaagaaaacaccatcagctactggagttctagtatccacaaattgaaaatgaaccaatggcctgaaacattctgaaactgacagcagagagaaatttcactattggtctgcacagagaggacatcacaaaaataatgaataatgtcctcaataatattctagcaatacatgcatttttccctcagtataggctgatgacaacataccagagtgtgactgtataaaataaccctgaaaagagcccactctgaagcagtctgcagccttctggctcaatcttgggttagcttttagaattcctagacaaaacagaagctaatactaacaataacaaaagtactaatagctaattcattcatttattcaactgatagttattgagcaactccatgagctaggcactgaagatacagcagtggacaaaacacataaaaatccctgctcccatggagcttcattctaggcagagaagatagaaaataacaaataaataagttaaatacatagtatgttggtaatgataaatgctgtgggaaaatagacaagtgagatagaaaggcaacacaagaattaaaaacaaaatagtggtatatgttctcataaaatatgtaccccagaatgcatacataaacctgaaccctttagagactataatattatgaggcattaattttttttgttttttccgagtggctttcaatctgtagctgtatgttagctatatgaaggtgagtatacatacatattgtgaaagcaaaaattgcatccgacaaagttaagcagcaaggacaaatgctattcaagacaattacaataggagagagaggccagaaatcagcctgctcaactccactataacaaggggtgggaggaactttagggactggtatgagctagtggaagggaactagagaacactggaggatgggggcaggttgatcactgggttgtgtgaagcacactgagtttgcaaaatacttttctctgtgattaggtcatctctgctggctaattggcacccattgaagttaggctcctactctcccttagagactggtagacaggggtgctatttttcatgatgattacatttcaaagggttggctcccagcaacttgagaaagacttccctgagtagtacaacaggcaagaggcttttaaaaatatttacatctcaaaggggcagagaaaggatttacaattacaattttttcttttgtaaatgctctaggaaaaaaagaagtcaggggctcagaatctgagagaagcctgtcaagtttagtcaagctgagggaaacatcaaggccttcttgattaaaaggtatacactcacacacacttgcttctaatttatcttaaaaatatatgctctgctatcagtgttctaaatgttttctttattgtgccatatttatctgacagaacctgaatagtaagcatttttaaagtgtgcatgaactgcatgaaaatcaccttatatgacaaatgatgatatgacaaacagcaaaaataattctttgtatataatccatcattgctaataggatataggcaagtcaatggaagtatgatacaggtgttcaataaatgtatttgtgttgattgattattgaagtttgctggatttcatgctccatgcatttcttcttaaagtatcagaatatgtctattaaattcttttatacattttaagagcttctggggagtatgtctggatgttctttaaaatgctttgtgacactgcagatgtcacatatgattttttaaaaaataatagccctgaatatccccagcagtgcaggaagaaatttgatagtatttacatagaagccatcttggcgtccatttctctaccaagtacaagatccacttttcaattcaaactcagtctggaagtttttcttccttccaaagggaacagaattaacaattccgcctagttctactattacggagattgcagacagaacagactgaatggaagatagcagtcagatgatgcccaagagtggcaaaaaacagtagatccagagagacagaaaggcaaatcattctggaggggtcttgaggccaacagtgtgagggaccaccaccttccttcaatacacttcaagatctaagtaaaataattcaataaccaagatttctttttttttgctgttgctaacaaacaggtataaaaagaaatgaccattttaatgaaggtcagttggggacagcaagaattatggagataaatgggctatagataacaaaggaaaagaatcccaagtgaaaccaaactggacacacacttggctaactgttggaaaggaagggttagaaattttgacagatacctacaattattttatttagagtttataaataattatgcttaaggtacgataacttctatacagtttccatcccaatgtccagtttcaattatttcaactaaaactcttgtattgttcataaagtctagagtataggaggtccctttaggcatcaaagatgagaagccaagtcagaaaaattctaactgaccattatgctcaagattccagtgctgagcagggcagggaagataaacagagctgtttaagcaagattcctgtctagggttgttgccatgacacagtttggaagaagaaggtctatcaacaacttatttcccctgtgcttcaatgagttaaagcattttctcacaagaaataaatgtgtagtgtttaaggatccttgacagagctccttgtaaactgagctctcagaagttgtcactggagacccaccatttattttccaaacaaaggtcaagattaaacttgagggatttacccaaatctctaatacaagaggattcagttaaggctagagttcacatccttatgcctaaacttcacaagagagaaaatctttcagaggcactggagagcaagagtgcctgattgatacacccttgttattcttaatattgccctctagcagtttttgaaatgaagtcttatgaggcagtaaaactctcttatgtatttttttctactttcatttacttcaacccaggatcatcatgtgactgagatgatcaggttcaaaagagaagggaaaatgtggtatgggtttgtattagtccattctcacactgctataaagaactacatgatactgggtaatttatgaagaaaacaggtttaattgactcacagttctgcaggttgtacaggcagcatggttgggaggcctcaagaaacctacaatcatggcggaagggtgaaggggaagcaagtatgtgctacatggaggagtaggagagagagcaggaaaggggaagtgctacatagttttaaacaaacgggtcttatgagaactcactcgctatcatgataacagcaaggaggaaatccatccccatgatccaatcacctcccaccaggtccctccccaaacactgggaattacaattcgacatgagatctgggtggggatatagagccaagccatatcagggtttatatttcattttgtctatctggcttgattgaccattgtagcagtgatggtatgtatattggaaaatgcaccaggcaggcgtaagtagcctctggtttcttgggattttagtaaagttattaaatagaacacatcatgcatcgctttagtctgcaatagtattttttaaagaaaaatgatcagttgaaagtggcagtaggattgtttaagtgtaggtccatttatggctcatttacagtttttatgtagctttgccaatgttttgtattcctgacagtcccatgagtcactgacatcttgtcaattacagtagccaacctctctacctgtatatctgcaggaaattggccgagatacaaatttaggaaatgtaaggtgtcattctttcagggaaggtacaatagctccaggaagtggataaaatgatctctcaaaaggaagaagggggtatcaagttccccacccctcctccttggttttcattatgtcccctcattgttttttatttcaaaattcgaataatgtgcaagctttgatacatccaggtttttaatcctgccaagaaaacattgtacttttgagataatcaagtagacagcactactcttaatcttgacaaaaagaaaagaaaaaataaataaaccacagagctgatgagaagaccctaaaggactcagagcttgtaatgacacacattatttcctttagtttgagtttttcctttcatgaagaaaactctaagatatacaaaaatagttctttatggcttgaagctcttatattgctaatggcttttgacagtggtattacagcttgtttaatccaattgaatttgattattcattcagtaagaagataaattagttgacagaggaaatgtttttcagtcactggttcatattaatgtctgaaaattcagttgtccagaaaaaaagagataggggtagaagagaagccaaagagatataattctaatcaaggattttcctgaaatttgaatttgactatgaagaaagtattgattgtggggagaaataatgttaattccctaaaacacagggtgagaactttttaatggagtacacattactcatcaaaatatagtcccaaactatattatcaaacatgtctaacccactttacacacatacacacacacacacacacacacacaccaccctacgatgcagttatatgaatctttattgtttactaaacataatacatttcctccttccccacttacgtgcctttgcacattgtattctttgtatcctcttcctagaatgctcttctttaaattgataaacttatccttcaaaatgcaacaaaaataccaccttttcaatgaagtccttcagaatccccccagtgtcccatagaaatttgcatatcctcttaattcaatgtcctgcaaccttctttgcacattagcacccctgggatttggcatgatcctatcagtaatgctgtctcagtggggttttatatgagaaggggctttctatgggtgaggcaacaatggttctctcttgtgaggttgaaatttccagggtatgagtttaatttgaaacacccacaactccccttccccacccctaccccagcataaactctggcatatccacttcctattccatggacaatcactgcttcactgctccacttattactgttgtcataacatcttgtgaatatttgtttccgcctctctttctgatactagatggtattattcatttttatggtcaatgttccccttctcacagtgaagtatttcacatataggaggtgctcaataaatgtttgttctaagaacaagggcatgaatgaatgagtaaatgcctgagtaacagaatgatttctaggacatcataggattcggcatccttaactggtgaagagatgaaccaaaacacagttatactcttgtgcagggagtggtctgggtagctttaatttgtcagtaacccccagccacatgttgctattgtgtatctgaagtgtgaataatctgaattgagatgtgctgtgagtgtaaaacttcacactggatttaggagacagtataaatacctatatatatatctacatatatataaaatatatcagtatcaaaaagcaaaacatctcaatttttatgttgattacttgttgagatattttgatctattgagttgaagtatattagtaaaattaatttcacctgtttctttttatttttctaatgtgactggtaaaaaaaaattgcatatgtagctcacatggcatgcattatattatatttctcttgaacagcactggtcttaagaaatgaatctcaggccctgaatggttgagtctaactttggcccactcagatgaaagtctctgtgcaggcaaacgaaggaagttgatgtgcacactgatctccttgaaagtgcattgaagctatactgaagagcactgggatcaacagtaatctttcaataatttctggttctccactattttccaggtatctaatctgatccacacttctcactgcgcttcttatcacatatcattaggtattagttgtgtgcacccttcacctcagcaccaaggctgtgttagcttcactcttaaggtccttcacctactaataactttccctttaccgggacaacacagatgctgcccaagctgcagtcttcctatcccctacccccaagtatcttactgaggcaccccttgctatggattcccattgcactgatagcattttcaacattatattgtaatttgctgtgtgtctcaataactagcctataagttctttgaaggcagagactctcacaatcaatatttaaatgttacacaccaagagaataaatcagttcagtgatgatctaatttgcccataaatttccatcaaacatctgccctagagaaatcatacttctttaaaaaaaaaacatatattatctgacataaagaaaacatatcaaagccctagctggaatcaagcttgatgactaaaatctacttaatcctcaaaaagccttgtgtcaggacccaccttctgcaaaagcattacagtttattatggaaaagcgattgctaaaacacgttggcttcctttttcctgtcaggagatctcattccagtgttaacctgaggagcctgcatatatttgcctttgtcccagaaatatataagtgttcctgtgctgtggagaattaggcactgggaagttaagagagggagagagagagagcccagaattggagtcccagtcttctaaatgcaacctatagcttggaaataaattagacttttaaagacagatatttattggaggtactcctaacaaatttttacctactcaagaaacctgagtcataattctcatattccattctggtctacctaacctcagcacacttatgtgactactaaaattgtttattaacttaaaaactttttgatggcaacaaaaaaagagcagtaaaaaaatgagaaaacatttacattataaataaaatccaaggccaggtgcagtggctcatgcctgtaatcccagcactttgggaggccaaggcaggcagatcacttgaggtcaggagtttgagaccagctggccagtatggtgaaaccccgtctctactaaaaatacaaaaattagccaggcatggtggtacacatctgtaatcccagctatttgggaggctgaggcaggagaatcgcttgaacctggaaagcggaggttgcagtgagccaacattgcgccactgcactccagcctgggtgacagagagactccatctcaaaaataaaaaatgaaaaataaaataaaatccaaaaatggtttatcatttattctttcactcagttaactctaaaagatatgtctacacatgcctccctaagaaagagctgataaatcttgaccactgaggccaagaaaatagttctagactcatctgttccctctcttgcataatctagtgttttcctgtctacacagtctaatctgtgataggtcatcctcttttaattcagggaccttattactaatcacagatagttcttggcttttgtttataaactttgtcaaagtctggatttaaagaagcaggttttctcaatgtatttctgcaagaggcaaaaaaaatcacatcaacaagttttacaaagggctgcttgcccttacttgcctttactgtgttgcttcagttctccgatcttccccactgtgaggacatagcaagaaggcaccttccacaagccaggaggaaacaggatgtactggcaccctgatcttgaactaccaccctccagaactgtgagaaaatacatttctgttatttaagccacccggtatagggtattttgttatagcaggccagatcgattattatagaagttcatatttgcagaagctcaacctagattatcgtgcttggacaagaaagaataactatgctaccaagatttaactataccattttatttcctttacacttgatagaatagatttctaaattagggcccaccagtgaattttaagggatcccctttttttctggggagagggtttattatacttatcaacttttcataagggatctctgatccaaaccttttttaaaaaattgctgtatgagatttccactggggaacccaaagctcataagccaaatatcaggaatctcaggtttctgctccacagacacatgattagacatcagtaaatgaagcataaatatttatccccttcttgtttctttggatacatttccccttccaatacccaggtaaaagtctttcctttaatgtgatctctaaattgtatacctttcttcaagagaactactaaaatcagacatgaaagctatataaaatatgatagctaaaataaagctctagaacaaccaattgtggagaaaatattttgaatccactttgagtgggttagtactgagtgataggaagcgtatcttagaaaagcttacttgaacatcaagggcagcagttgctctttggttaattcgcatgctttcagctattctctatccaggcagtcaccatggtggagggaaatctgctgaaaacaaggaccaagcattccttacctgtaaaaagctgacagagcaccttcatttctagccacaggactcccttctgcactagtctctaaccctgaaaggcacttgtttgtacttcagggaggtaaggctggatgtcacctctagataggttcagagggatgattgtgtccattcaagatgtctgtcagccatcaccattactaggaccctgagaatctgtttaaatatatatatacatgcatgtgtatttgtatcaacatatttatatatatcaacatatttatatatatcaacatatttatatatatcaatatgtttatattgatataatatacatagatatatagatatgtccatataaatacatatatagatatataatatttaattatgcataatgtattttatataatatatattatttatattatatgacatatataatatataatatattacacaatatctatatctatatatcatgcatcctaaatgctctattttcccaagcagatagccatctttttcactgtcttaaaggatgctcattcaacaagctactacatatgtatatgcatatgtatatgtatatgtattgcgtatgtgtatgtatgtgtatatatatatatgtatatatatgctagcattttcttgtacagagcagtattatgccccttcattagaggaaacaaacttttagaggtaaggtttcattgacaaacactttatttaaaagcttatggagaatttcccctaaaatacttcagactttttattctatcataaggaattaatgttgtccatcagcaggaaaaaatgcagcacattgtcttaattatttagaggtttcactttttttgagtagtgggagggctatgaataaaacaaaaacatgcttacattttcctaaatttttaacttggattccatttaccgctacctatcagaaagatggtgcgggaattagactgtggcagcggttggggtggggatggaatatgggaaccgggactatcacttttagagttttatttccacatccagttttcaaatctgtccttgttttcatgttttattggcaactggtttggagtacagaggctaaacatacccatctatgtgaaatacttgaaagacgatcaatttaaatacaaaatctgaaagaaaattgaaacagttcatcaatctcaggaagtttcaggaatatctaaatgtaatgaacataataaattgatgaccgactggcgtttccaattttcttcaagaccattggaaatcttttcataagagtctttgagttgttttaagagtctctcaagcatacaaatatataacaaattaaaaagaagttataaaatataactgctatgtgctccgatattaacaatcaattctttttcaaatgtgtaggtgatgttcttaagcagctgtggccacagtagggatctgtgtcagtactagtctggatttgcccttcacttgtgtcctgaatttttatatttctaacccttgttgtttattgtttctataccccacactgctctatacctgtctagtcaattcctggtaacaggataatctaagagtgaagagttttgtgtactttgcaaccgttctaaatttgtagctgcaaatgcaagttttccatctcagccacgcaggcttcatcaaccatatttctattgctcttgttatttctatttctgttttgaattgctcttttttagcccctaccacaagaagcagagctgtgatgacactttcatgtggctaacgtcaaatccactaggcttcttgcctgaatcaccatgagtgaaagtgttgggataccactgtggctttcagaatgaataaaccctgctctcattcagctgctgttttcaaagttgctttcagtgttgaattttaagtgggattctttctgatttttcactacagacacaagttggtgtgtatggatctcagcctagtcgaccatgacttggcattttaaccaagtcataattctcaatggacatttttgaaagatgctgatcaattgtccattgaggaaaaatagtctacatactctcacttggcaaacattccccaaatttttcagcctctttagatataattaaaagagataatgatggtgggatgtcaggaggctccccttttcccactgaaaccagggagattcagatgaggctcaaatcagtacaaatgggattcaagttaagtctaagaatctaatttctgaatctaagtctttaaatctggtagaatagtaaaaggtttgtcttcaagagattttttaaaagaggggacaatttgcatacaatatttattgagaatctactaaatgctagataaccagagacggtaagacgctgtttctgctcctatggagcttgcagtatggaatcagtcagctaattagagaagaagttatgacaaagtttgggttatattatgacagaggaaattcaggatattctagtatcaaggaaaagtaaagaaaaggacttctggaagaagtgccacctcaaaagtgcctgaagggtgagtgagttggaattagtcatgaaaagaaggaatagaggtagaaggaggtttgaagtactcacgaaagcattcatttactagtgcaaatgagagcatggtggaacaacatggaactgacagaaacttagaatggttgaaattcaaatggacagggtgaaggggatatgagatgagtatgaaacacaaggtcatattggggtgaaaattgcaagccatattaaggaatttgtaattttttttcctaaggaaaatagccattgaaggtcttctttttttttattttataattattacactttaagtttggaaaggacaccactggcaacaatgtgaccaatgaattaggggcgagttaggatgtaaggagaccaggtaagaggctatgaaaagtagttgcaatttggactaggatagtagctgaggacacagggaggactggagggaatcaggacattgctaaagggtcaattaccgtagattgattgaatgcaaaggggaaagaaaaaaaaggaagctggtcaatggatacgaggaattaagatgatagcctgaaagtaagggtatttattaaaaaccaaaaatataatccacgctgggcctggtggctcacacctgtaatcccagcactttgggaggccaaaatgggtagatcacttgagcccaggagtttgagaccagcctgggcaacatggtgcaaccctgtctctacaaaaaaatataaagctagccaggcatagtggcatgcacctgtagtcccagatacttggaaagctgaggtgggaggatcacttaagccggggagattgagactgcagtgagccatgatggtgcaactgcactccagcctgggcaacagagcgagatgctgtctcaaaacaaaacaaaacaaatatgattccaggaatttaagcatagagctttgtttttatcaaagactaaaaaataaatgattcagagtctttcttgttcaatgattttattagtattaactagtctttcagtgctgagaagccatttaattttttaagtcacctctagctgtaagctcaattcacagtattttttgtgaaataaccatcttcattcagagtttagttagccacccccacaagtaggaagaaatccaaggtttatatatttaacattctataaaagatctgtgtataaatattaaattccttagcataatttgaaaaagttcagattgagaaaatttgagtgcaaagtagtttgaattatacagcaaaaagaatatactctatgcgacatatattttctaagaggtatgcacaatttatgtattttatgtaataataattgaaacaaacaaaaaacttaatggatttacatagctagattctatcttaagaattaccaaaagaacatagaatattaatctattcatggcataggagggttgtcaatgtttattatgtggtgctttaaaaaatatgtaatatatgttctgtatctgtacaagttattgataagagaaagatactgaaaaatggtcccataccaacaattcctatcagaccaatcttacttcatcgtataatgaatgttacaggggatggaaggaaacaaaaatattaaaaatgaatgtttgaattatgtcctgatcagtattaatatgccaggaatatattttagaaacccaacagtactaggggaaatgataatgaatgtgaagccctggtaatcaatatattattatgaaatactgtttacagttttgtttcattttttctaaaaatattcaaagcaaatctatgctgagtaaagagtttggcatctgtcttatttatagatctatcctggatgtgtatgtgtgacacaatacaaatttctcaccttttctgcccctaaacttgtttaccctcctatgttccctgtgtccttgatggttccccctagctactaggcaccaaaacaaaatctgggaagcatgctagacctcacccctgtcatctagtcaatctctggattcagtcaattgtaattcctaaatattgctcaagtccaaattttgtcatatagatctacctcctagcccttgatatcactcagctgaattattgcaatattcccctaactggactctctgcattgaattctcacttttcttttaaattatcattcactcttccaccagacagatgaatctaaaacacagttcagaccaggtaacactctgtctaaaccccttgatcatcattcctgcttctttcagtatatagtttttattctttctttgtaaaattgtaatggaatttcaaatgttatgattgcagtgacttccagtatgacaataacagaatatcttgtatcagatgaacccatcctcagaaaacaattataaattgtgtacaaagtattttaaaaacaaaaatttaaaggcactaaagagtgatcaaaagcagacagaaactagtggtgaattaatccttgaaattagagagtcacatgggttttatagtttttccccagaggccctctctggtccccgcaatatttagaatatagaactaaaacaaaatgaaacttgccttcttattgaagtcaaattaggaatttcctttccaggaaatggaatcacagaaggggaagatggaggagtcacagaaggggaagcctcaaaagttgcataataatatcccctaaaatccttggctgactgcttgtgcacgggagcaactccagggaagccgggaggaaaaccacagaaaaaacattgaaaggatgaaaaaccgatcatatatttcagctgctacctactgcagagaaacagtttagagttcaagttcaaccaaattagaggggcttagaaaacactgtgagttttccattgaaattccagaaaggttacacatatgaagtaaagaccacattccaggactaagggattatttgctcttcaacttgagacaaaactaaaacaggcttaacttagcaaattgtgaaaccaaaccccacaagttcaaaatcatctgcctataatttagctatctgctagaataaaacgacctctatttagtgtgagagttagcaaactaaaacccatggcctatttttgtatgaccctcaagataaggaagacttttacattcttaaagggtggagaaggaggaggaaggaaggagaggaggaaagagaagaggaagaagaaaagaaagaggaagtgttggggaagaagaaaaggaagaggaagggaaagggaagaaataccaataaccaaaggttgcctacaaggcctaaaatatttaccatatatccctttatagaaaaagtttcccagtacaccctttaaagaaatatggtataatccagaacctctacaatgtattatctgtgatatcccaaatgccattaaaaagtattggtaatgtaaagaaacaagtaaatgtgtccataaaacgataaagttggttaacagaaataggtctacaatgctggtccataaaagaaccttaaaataatcatgacaattatttcaaatatggtttcagttgatgaaaaggggagaaattctgggagagatttgtaaactgaaaagaataacaaaaacaaatgaaaattctagaactaaaacaatttaacatccgaaatttaaaaatcatttaataagattatcaatggattagatacaatagaaataatggattaatgagtgtgaagactacttaataaaaacatccaaacttaaacaaagagagagaaaaaagtttgaaaaaatctaacaaaacttcaaggatctgtgggacagtacaagtctaatgtgtataattagtgtttcagcaaagaagaaagacaatgcatttcaatatgtgtatatctatatctgtacacacatattagctgaagaatgttcaaatttgactaaaaactgtggatcaaattttttaatttgatccaaaggctcaggaagctcggtgaatttcaaacaggatgaatactaatgtgatattgtgagttggctttagggaggttcagggaacctttggagttggaggctcacttcacagagcttgctatagctctacaaagagtgctttcttctccacgaggacaaaggtcttcattcttggttaagtagttggaaagtaaaaaggaaactttaccctcagatgctaaattggtatacatttatcatttattgagtttccactatgtgctaggccattctgggtgctttagcatgttatgtcatttaatccttacaatcttgtgtataattttatagataaagaacctaaggctcacagaggtatgcaacttgtgccaggtcacaagtcataatttttagaagaaatttaaatacaattgatctataaatgaaacctgtactctttccaccacttttcccttagaccccacagcatatacaaatatatgcacaatggttataactatttgctaaactaataactgtctttgttttgtgctaccataacagcagaccagacactgggtaataaattaaataaaaagaaacatttctcacagttctgaaggctgggaagtccaatggcaaggggttggcatcttgaaagggccttcttgctgtgtcacctcatggcagaaggtgagacgacgagagagtgagagacagagcaagggaaggggactaaactcacccttttataatgaacccactcccacaataacagcataaatctgtttatgagggcagaaccctcatggcctaatcacctgtcattaggacccacttcccagcactgttgcactggaaattaactttccagcacatgctttttgggggatacattcaaaccacagcatttagcccctggcccttaaaattcatgttcttctcacatgcaaaatatgtttattccatcccaataacctcaaagtcttaatgtgctctagcatcaactcagaaaaagtccagagtctaaatcaggtatatgtgagactcaaggcacaattcatcctgaggcaaattcctctactgctgtgagcctgtgaaataaaaataagctatataattgcaaaacataatggtgagataggcataggatagccatttcattacaaaaggaagaagtaggcaagaagaaatgagaaactgatcccaggtaagtaaaaaacccaacagggtaagcaatgttgaatcttaaagcagtagaatcatcttttttgactcaatgtcctttgtgcacactcgggtaggagttgggcttccaaggccttgggcagtcccacccctatgactatgctggggacagcccacacagcagcttttgcatgttggattctcctgtctgcagccctcccaggctggagttccatgatggtggctctacagttgtggagtctcaacagcaacctgacctccgtgactccaggaggtattgccctagtggaactttctgtagtggctctgcctcatgacaagtctctgtctgagcaccaaggctgtctgagaaatcttttaaaatctaggtgaaagaagccatgactccgcagctcttgtatttcatgagtcttcagaattagccccatgtagatgctgtcagtttatgacttaccccttccaaagtagtgacacaagctggattgaggctggcttgaattgtagctggggtggtcaaggaatgctgcaccagaatggggagagcagaaatctgaagtggcacagggcaacagatgctgaggtcctgcaggcaactctctctggaagccttggtcaagatacagaacgaatccaccaggatgctttcttagcccagaatctggcttatttgctctatggttcagtattgaacctgtactttagtttcctattgtgtattctgtttacccagttgggtctggggttgcctttggctggatcccagccatcaagatatgttttactgtgagtggagtctaccttctttatctactgggagaggccctgatgtaaagcaagcaggccacttggaagtacattaatcacttgggaaatttctctgtctcctgtggctatcaaacaccaacttagattgagtaccattttatttcttgatccttttgggcactgaaaaacgtacaactatttgtttctagatgactgtcctatcaatgaaggccatgttttgcaaatcatagcatttcccaattacctgatcccatcctttatgcactaggcatatattgagatttccaaatgcctagcagcagagtcttagtaagattttggagttttcaaaatccagtctccttgaatatttatctaagtgtgaagggttgtagtatttgtgattggtgagcattcaatctgctgtaacacacctgaaactctggctttacaaagcaacaataatattaactaacacttactgaatacttgctgtagccagttttatatatgcattatctcatttttaatttttataacaaccatacaaggggagtgtggtagtcagaataatggcctccaaaagatgtccaaattctaaaccccaaacctgtgaatctgttacgttatatggcaaaggggaattagggatcagggtaacagggtaacagatgaaggtaagattgctaatcagttggtcttaaaatggcgagattatcctggattatgtggatggacccaatataatcagaaggtttcttaaatgtggaagagagaggcagaatagtcagtgtcacagtaacacaatgtgagaaggactcggctggctattgctaaatttgaagatagaaggaagccacaagctgaagaattaggcagcctccagaagctggaaaaggcaaggaaacagattttcctctggaccctccagaaggaagacagtccagccaacaccttgattttagtccacttagacccacatcaggtttctgacatgcaaaactgaaagataaatgtgtgttgtttcaagccactcagtttatgatcatctgttacagcagtagtaggtaactaatacaagcaagtactataatagtcctgaatattagatgtaaaattttgagccttagatggagttaattacctcaataaacaaatactttgtttaaaggcagtctcatagtttggactaggaagaaggcaatctgacaaagttcctgtttttctttttaagatgaaattatttcttctatcctcatctttccaaatggatgtatggcactggttgactgcatatattgtcatacagcatacgaccttaaaatctaaaaacttaacctgctcataataaaggaatttttctgcaaaatatcccttatttcacaaccatgagataaatatcacatatgatgtggtttggatatttgtccttacccatatctcatgtcgaattgtaatccccagtgttggaggaggggcctggtgagaggtgatttgatcgtggggttgatccttcatgaatagtttagcaccttgggtgctgttcttgtgagtgagtacttgtgagatctggttgtttaaaagtgtgttggcaggccaagcgtggtggctcacgcctgtaatcccagcactttgggaggccgaggcaggtgggtcactcgaggtcaggagttcaagaatgttgaaaccccatctctactacaaacacaaaaattagccaggcacagtggcacatgcttgaacccaggaggcagaggttgccgtgtgccaagattgtgccactgcactccagcctaggcaacacagcaagactccatctcaaaaaagaaaaattaaaaaaattaaaaaaaataaaagtgtgttggctgggcaaggtggctcacgcctgaaatcccagaactttgggaggccatggttggggatcacttgagggtaggagttcgagactagcccggccaacatggtgaaaccccatctctactaaaaatacaaaaattagccgggcatggtggtgctcacctgtaattccagctactcaggaggctgagacaggagaatcgcttgaacccaggaggtggaggctgcagtgagccagcctcacagcctccacagttagtggagattgtgccactgcattccagcctgggcaactgagtgagactccatcttcccacccccgaaaaagtgtgtagtacttactccctctctctcttcctcctgctccagccatgtaagacgtgcctgcttccccttcaccttccatcatgattgtttccagagacctccccagaagccaagcagaagccactgtgtttcctgtgcaacctgcagaaccatgagctaattaaactgcttttctttataagttgcccagactcaggtatttctttatagcagtgcaagaatggattaagaccatgtagctcaagtggccaaaaaaaaaaaaacctcacaattctagtacaattttccatgtaagaagtacaaaaactaaagaagtcaacaaaagagagttacccaagtgacgaagtccatcagaaaatggtttaagtctatcagaaaataacttaaaactggaaataaaatgtggatgtttttgagctaaagtgctgttttctgatgtgtactctataaattaggtagttatatctcttcaagtaaactacttcatattagtgtttttggcatcatataacagagctttaatgttgatgccagattccttaggggtgacagacacatcacactagcatacttcatgataagccccatgtgtgtttttattaaatattacagtaaaacctcacctgcatatttttaaattagttatttctgtgataaatccttcaccaggcaatgatctagactgagactaaaattgcctcaagcactttcatttttagtgctttgttccagtgactttaatctctagcttacttcataagcaaagtatatactgataaatacaatgaagcctaagccctatttggctgaatacactattctgtagggaaatgaaatgaagtcaactagttacacaaaaactatgtttagcaatttactaatcttatttgtaaggcagcagagcagagagccaagacaaccattgccttaatcctttcttccttaacttatttctactgacagccagcttctggttgtctcctagggctaagcttaagagtctggctgggaaagagctctcacactggcagggctcccctccaccacttactctgaagctcccctagtccagcaaataagcattcagaaacagtcctttcgtatgtgctcaggccatctattcaaatctcttagtcacagcccttcattgctttcctgtcttggatgactcagaaataataaagtatttttcttcttgtatgtctccagtaattttatgtggacatcatggctatataagttgcctagagccacaatatagctgcataacaaatgatcccccaaactcagcatcttacaacaacatttattcttacacttgtggatctgtaactgatatggtttggctaattgaggctctctttcaagctgtgggttggctggacttggctcttgactgcaggttcacttcaagtctgttccaaggtttttgttctgaggctagactgatggggaacctgctatccagggcaagtgcttctgatggtggaatgcttcagcccaggaggccaagcagaaccattcaggcacatttctagtctctgtttcactaacatccaatagtcaaagcaagttatatgtttaagcccaaagtcaaagagtaggaaaaatacacttcactcacatgagagcaaggcaagagagggaataagataaacctgtcatgggacaatgaagaattgagaccaaaaagtcaatctacagtggcccatatcacagaatagattaagcttcttggtgaaccaattcctggaaggactgaggtaaaggggagtgaagaaaaaaactgcagttggaagagctatgagttcccagcaataaagcaaattaggcagttccaaattgagatcgcattagatggttttatttgctagcactttcaattcttgcatttttagcataattataatacatctgcacggccttcagtagttattctcctcatttctcacctttgtatatattctgctactagtgctgaagaatatataaattatgctaggtatagagtttgaaaggcctaaattttaatcacagatctataatgtacttgctaagtaaccctgagcaagtccttcaaggtttcttggcctgtttcctcacctttaaattgcgacaatatctgtgcttcagaattcttgcaaatattagatattatacatgcaatactgctggcacgtaataggggtctgaaaacaatggaaactgattttcttctaaacccttagtctttccccttctccctgtcctttcacccagcatctccccctagaaatgtttctgtttgtttatttagaacagtcagtaggcatcaatggcattttggggccatgacattggggactttctcattggttggcaagtccctgactttgtcctcattcctcttcttcaactcagtattctgtgctatagcataaaggaaattgaagtaagaaattttgagcatgtcagtgtctaattgtacaatcagtttccaactaggctataaagaaagagatttcaccccctgccagagtgctttaggtcaatagggttgagaagctttaaatattcctctctaaggaaagatcccttgagactctacatctcacctcagactggatgttactccacttcagtgtcttcatatggattataattataattttctgataaattgtgtaattattgactagcatacagtctatttcaaaaaggtaggagttatttctctttttcaccactggaatcttagcagttggcacagcagatgctctataaatatctgtcaaataaatgaacaaaagaattatggctgagcctggattttagagaaactgaaagccttcctaattaaatacaaactcagcccattactttcacttctcaactttaaatttatgtttattatgctcttacacatcatctttaggctgttcttccacataattgtcagtcctcagccttaatatttgaattctaataaactgctcttagaggcttactgtgtaacagctgagttttctactttatatgcatgcagtatctagaggttaaagaggaggtcattataatctaaccagaatatgtttgaatttataaaatgaatgataatattaccatgaagctctcatcactccacagtttgactgttaaacaataggactttaactttttaattctcataaattgatataattgcacttagacttatttatctttattgtagtttctttagaaaaaaagcaaatgtttggcaattatttaaaggaatcaccataaaacactcttcagaatttgaactgaagtagtagctcaagtgttgccaaataattcactaaactatgaaatcatgtgtgtgtgtagaaataatatatacaatccattctaacctgttacttgatataaatatatactgcataaccatatataataatataatactttatatatagttttatatacaatgcacatataatgcaagaatataaattagttttaaacaatgcataaaattttagcatgctctttttatggaaagtttctaaataacataatttttattctaattaaattaatttgaaattatttataaaactatatggaagcaataaaaccacctacaatgggatgttcctagagtcctcattggtagcatccaggaaaaaagaagcccttttaaattttaggtttttttttctttgtgaaactatatatacaaaaagaaaaaactaataaaactaaagtcatactgcataaataattgtgctctctgatttttttcactcaaaatacacagtatatagtacgcatatctttcaaaagtctttaatcgaatcattttactggccatatagcatctcattctatgtatttacccagtcctcttatattggacattcaagataatttaagttttctaatattataaataagacagtaatgatagtcatttgctaggtattccaccatacccaaaagcaagcttcagcctaactaggtaataatgcatgttttggtcagtttcaaatccggttgataatcaaaccataataaattggttgtcctttggccaggtacccatgcctgattgaaccaatcagggccaacaaaccctgggtagaaatgttcacaggatagaaaatagtgctaatcaaagtgttgcatctggagtgccattcaaaattaggcaagatggttttaggtggcacatgaacacatgaatagtttcatgtttgttttcaatgaataatgaggtaacatcagtaaggtaatctcttttcatgaatattaacatcagttttagtgataacattttattaattcattgaacaaatatgtacggaggatctctcaggtaagcattggggatgctactataagcaagacataaaatttctaacctcaggaggcttacattctagcaagagaaatgagtaatatggaggaaatatcagaaagtaagagaatataaaatgtgcagccttggcctcactttagataagggagatctcggaattggaaggtatctcttctatgaaataagggaataagctgtataaggatcaagtacaaagacccaaaagatagagcaagcttggtgcactgcaggaagcaaattcagccagcttggagtaagggagggctggtaaagatgacatcagaaaggtgggtcaggggccagatcacaaacagccttgtgagcattagtaaggacttaccatgttctcagtgtaacagcaaactatgggacggtttaaaccaggttaattgaccaaatttatattttgaaaacaatctgctgctgtgtgaagaattgattgaaagcatgcaagaacagaaataggaagacatgttaggagattaatacaacactcagatataataatagtgtggaccaaaatgatagaagtggagacagtgagaattaacaaattcaaggcactttttgaagtagaggtgacaagacttgttgatgatagatatgccaaatgtgagccaggcaccatggctcttgcctatgatcccagcacttacgaagcctgaggcaggaagatcgcttgagcccaggagttcaagatcagcccaggcaacatagcaagacaccccatctctacaaaaaatagaaaaaaataaccacgtgtgctggtgcatacctgtagtctcaactactcgggagtctgaggtgggaggattgcttgagcccgagaagataaagctgtggtgggccgttaccatgccactgcactccagactgggtgatagagtaagagctttaagaaaaaaaagaaggaaagaaagaaagagagagagagaggaaggaaggaaggaaggaaggaaggaaggaaggaaggaaggaaggaaggaaggaaggaaagaaggaaggaaggaaggaaggaaaagagaaggaaaaaagtcaaatttgagaaaataaagaaaaaggatagtgcctagacatttgattgtgcagtttaggggatggataagccaaggggaatccatataaagagcagatgtgagaagaaaaaaaaattttggttttaacatgttatgcttcttagatacacaaatgaatgtacctactaggcaattggatatttaaacctagagcttaggagaaaggacggagggggattatcatcagcatgaagatgctgtgtgaggccatgtgcctggatgaaatggtctagggagtgagtacaggcagtgaagaaggcaggaccaagcaagaacatcaagctggagtgctctaatattgagaaaggtagagtgtgcagagaaaaccaggatgcaacagctgtgtgatggaacaacaactaggagatagtggtatccagaagggctcgagaagaaaatgcttcagggtggatgatgattgtgccaaatctgctgtgaggctgcataaaatgaagattgaaaattaactgctgctcttagcaacagggagattgctggtgattttgacagagcaatttcaggagagtgatgaggactaaatcccaacttgagtgggctaaagagatgagaagtgagaaagtgagagcgagtacagaaaagtctcaagaaacttgctatgaagaagagttgaggaatgcaactggagctagagtgcaaccagaagtctaggaaaggattgggtttgttttgctgagatgggggtctatttgtaagctgatgggaatgatctacagtaagaagggagagtcatgttcaggagaaaaaagatgattagaggagtaaagccctggcacaggtggaagggggtgagaagccaggctgcaggagctgtttatcgtctgtgaccaaagagaagatggaacacttgggtgtggagcaaggaggttggtagatttggtaaagggaaaaggaagtagttctcttctgcttacttctattttcttatgaaataaaaatctaggttatcagctgagagtgaagacaaggagggaatgttggaggtttaaaaaggggggaagatatcaaacagttgtctggacaaagaactgaccagagaattctactataaaaaatttattgaagtgctgaggacccaccagagatttgtggccaaaatgtaaagtaaatgtgtgtgttgttctctcatcccatttagctgcctgaatgcagatatagattaagcagagttaaatataaccagggtttgggttttgctaggcaaatataatggagagagagaaggacaaaagagttgagggtacatagagaagagttatagtgacaaaccatggaatctaagacgagtagggaaaaaggtaaagaaaagcgagggagatgattaggacaaagactgggagtgggtccatggattacttgaatgatgttgtacttaagagaggagtcagaaagagatgctgtgaatatcagaaagtggaatgatgaaaaactagatattggaggctacttataatgacaaactctagggtatgactagggtgaacatgatggggttggggaaagaaagagatgttggagtcagaaggtcaaataattgaaaaggcttactgagaaactgatctaagtaagtagtgctgaaccctgctgcatattgagatcataggtgttgtggggtttttttttttttttttttttttagagcaaaacaaaatctagtggctaaatcctaccttgactaaattaaatcagtacctgtttggcttgggggatgaactgaacacaggtaggatttttaaaacatcatgaggtaataaaaatgtgcagccaaatttgaaaaataatgacatacataaattttgaagtcattaaatatgatgacaggagtcatggtagaaggaaatgcaatgagccagctgctaaaatcttccatcatgaagtggaatggcttggaagataggagatgaagggtttttgaaagaagaaaaacaatgagaaataaggaacattcctatccccacctccaggacctggaagcatagggtgtgggagcaaaaaccaccaccccctgcaaaggctgaaggtaaacaggatatgggttgggttgggtggtgagccagggcttagagcaagaaggtgaaggtgttgttcaaagaagagttggaaaataaaagagactgtgcttcccaagccctgaattctagcagctgcattggaagggattgcagttttggaaggaatgggagattgagtcagatcaagggatatacagaaacatatggaggagagttcctgtggtgacctggaatgcttggacttctatggtgactgaggccaaaaggagtatgaaacatgatgattagttccatcgcctctaaaggaaaggtggaaaattaattctaagtatatcctccttcttgggataggatccttgggtggtatgtgatgatgaagcaggttgaggagctaggtgcttgaggtggtgtgaaaggagcctgggaggttctgaagcccttttaagttgagctgggggcagtgtcaaaagggagataggataatagcccctctactgttaactgtaaactgtgagtctcctttaaaatctttgacacaagcagttaaatggtctggttcttaagatttaccaaattatgttgcaatcaattttctgtatctgtctgcactaagctttaaattgccccagcagaaatcttttcttatgtatcttttcattttcagcacctagattaagaaacatttgaggtactgaagttaactgcttaaagaaccaaagacaaggttttgttgtgctaaagtgaagtaaccaaataaggcaacattttttgttagcatttctggattgtaattttaccaggccggaagtgttactaaatgcactcatatttttaaccacaaacaggactttccttttttactagttcaaagagttaaaatagtttctgccaggaattgatgcaataatatatgtgtttaagtgttacattaagaaatcaatatttctagcttgcactaagcacattaagcatcccttaacttaaaagtgtgaacagtgtgttcgcttgagattaatttcataaaacgaaaagataaattagatcacctaacctaaggagacaatgagatgccagcattgtctttagttctaaactctgctctatttggggcatagatttttttttccctttctcagagcttgttgtttggatcagggagatctaatgcaataaggaaagtaaagagacattcccttcaaaaaatctgccttctgctctcagcttctacagtgagtagaatcctattgtatttcttataattattatctcataaaaccaaataccagatgttcaacgtgatggtctgcaacttttttttttcaatcattcttatatggcatatcacaataaaccgcaaagttaagaattcatttataagaaaaaatagaagaacaagataattttatctggatgaaaccagatataataaaaaagattcaaagaaaaattttcaaatacgtaaagatttgaaaaatcacaattatgtaaatcaaaaaactacaatggaagggaaaattattttcatcagatgtaaaaaaaaaagggttcatatctaaatttaagtgtataagaaaataattccgcccaagcaaggtggctcacaccttaatctccacactttgggaagccaacctgggaggattgcttgctcccaggagttcaagaccagccttggcgatgtagggagaccccatctctacagaaaattaaaaaattagctaggtgtgggtgcacatgcctgcaatctcagctacttggaggctgaggtgggtggattgcctgaacccaggagatcaaggctgcagtgattcatgattgcaccactgcatttcagctcggatgacagagtgagactctgtctcaataaaaaagaaaagaaaagaatttcaagagttcagtggtcaaatgatatgagcaagacttcacacaagaagagatataaacatttgtttatatctatcaaataataatacaaattctagtgatgacatgctgtaaaatattcacataatacgatattgtaacttagggcaaccattttagaaagttttattgaaatgtcattcttctaaaagttcacattttatctttagcaattatgttccttaagcaaaaaacaatagaattaatataaattttccaacatgttccttgtgatattactttacagttatgaaatataattatattttgcctcactcaaaaacaagggtaaatctgagtgccgtcttgcatatataataaaataatagtaggaacaacctgtacatattacaacaaaagtatcgttataatactataaaaggtatgtggcattcttgcactattgcaggaaatgatgcaacaacttgatggagctattaaaagtaacacatgaagtctatatagccaaatcaaaaagatatttatgcagaaaaaagaaaaaataagtttaaaattgcatgtgtacagagattacaccccataaacacatatagaatttggattaagattaaaaggagctacattccttggcgatcatcaaaaagtcaggaaacaacaggtgccggagaggatgtggagaaataggaacatttttacactgttggtgggactgtaaactagttcaaccatggttgaagtcagtgtggcgattcctcaaggatctagaactagaaataccatttgacccagccatcccattactgggtatatacccaaaggattataaatcatgctgctataaagacacatgcacacatatgtttactgcagcactattcacaatagcaaagacttggaaccaacccaaatgtccatcaatgatagactggattaagaaaatgtggcacatatacaccatggaatactatgcagccataaaaaaggatgagttcatgtcctttgtagggacatggatgaagctggaaaccatcattctcagcaaactatcgcaaggacaaaaaaccaaacactgcatgttctcactcataggtgggaagtgaacaatgagaacgcttggacacaggacggggaacatcacacaccggggcctgtcatggggtggggggagaggggagagatagcattaggagatatacctaatgtaaatgatgagttaataggtgcagcacaccaacatggcacatgtatacatatgtaacaaacctgcacgttgtgcacatgtaccctagaacttaaagtataatttaaaaaggagctacgttcttaatatattcatttcaaaattgataatagtagtagctaatatttgctaagcacttacgatgtgtcaagcactgttctaagtactttgtatatttaatctaatataatcctgaaacaacctcattcgttagctactattaatatctctatgttataggtgaggaaactgaagtgcaaagaagcttaataagttttttcaagttcactcagctacaaaagggaataggtggaattcaaacctatgcaatgtgacctcatgaaaatagaactatagattatttttttcatgctgtcctatattatgattgaaatattgctcaaattatttttaaaagaaggaattttctgtaatcttttccactccaaaaaagctaaatgtgtagaaaacatatctctgtagtgctttaccaaattctgtagtatttctctaactctttgaggattacttagtctaaaaagcacctgggaaaacaaggatcagcactccacatcctagtatcattcctaataaaccagtttcacctataccttgattaaagagagttaatgccaccagcttccaggaactatcagctctaccgtgcctgttgggacaaagattattatcatatgttctcatttacctggtgaacacactgcactctactgtaggtgaacactcctacactaaagaaataactacaatcaaattatagaaaatcatactttccttgattgcagagacataggttagaaaaaaatgtgtaacaacctttttttaccttttcataaataaaatcctgcagggaattctctaacttgaacattgttaacagatgacataccaatctcttttgctttcactcaagaacaaaggtaaatctgagtgtcatcgtgtgtatacactcagtttagattccttttagagaaataatatactggtttgtcttgcatagtttggggccgctggattgtggtgacattttcagtaaaccccaaatgctgattaatctctccaaactagtcctcttatctagctcattcctaagaatcaatattctttaaaaaaattttccaatatataatcatttaaatattttaggggcttttcctataagtcttcagcgataatcaaagagacctgagacagaagaagaaaacaacaaatacacagaaactaatttccacctgtgacaactccattgatttatctttggaatagaaactgctttcattctctttggaatgtgctgattttttttttcttagattgtatctcagtgacctgggttaagtacaagatactcagcaagttgttcagtaggtaaaaggaagtcactaatttatcccctctacctattgccaagcaaattcacttaggggtgaggctccagaaatgctttcttcatgactgaccagcagttagatgacatggcttctgggacagaatgacggcgttagcagagtcagggctaaactttgttagtgcttctcacctttgcataagtcatttcaaccaacagtcttgttttcacttcctgtccaggtgaagagaagggcaatgattaaaacctactccctggcatatttgtaaaacattttgaatttctcctaatgggattttttttttctagaaagtgcaaaacactagattacattaaccatctttaatgctacgctgagacaaattatatagatataatttataaaggaataattttaatatattaagaggcatttctatgttgaaggagaaaatttatgtattttatacatgacattatattttatttgataatatatataatatacatctgctagttgagatttctcttttaaaaaaactgtgttacaaatttatttttaagaaagtgggtctaattggaaatggcataaagaaagatttcactgggacacaggatgtttttgtaaataaagtatgattcagcatcaaatttataacaatttaaacaaaaatttaggaaagatttcacaggcctccagctgaaagttcttttttttaaattccagtcagcgtttttggttttccttaaagtgatcatgatttgaaatgactaggaagtacctgctgccttgcgtgggaatagaaatttacttccttaaacctatacagggtttgctaggatttaatttctatgtaaggcagaggttagaatatattcacctctaatcagtctgtccggctgtaagatcccttttcaggaattgtttctaggacacacacacaaaaaattggtggggaaaactacattctcatttatttcttccctaacactggttgtttaaacccacccacaaatcagaattaagtgcttcttctctgggccataaacctcccactttgctccttaagtacactctcatgtcactctgctttgaattaaaattatttgttttcaggttgacttcctctagtagagtataagctccttagaggccaaaatctgtgtcttattcattcaagtggaccctacagctagggtgtcatataatttactgtccaatcttggacaatagctacaagtgtacctctggtctcacacagacttggtccagacttgattgtgatctcatctgtacaatgggcataatatgagtagacatcttatattactttgagaaataaataaaataattcataaaatatacttagctctatatcatgccattatatgtagcaagaatttggggaggaaaagcttgttgagtccttcaattgaatcaaacctcttgcttttcttccaatttttaagcttttctttcaactcttatttcccctcttatctgagcttcagataacttcgttttctttctgtttttctctggaattgctcttagggccttgtgagttttgtccttctgttttcttttcttttcttttcttttggcaggaggagagggacatctttcaattcattcattcaatgggcatatgcagaggacttcttgtatgctcaaggtggtaatggaaatgtgccaaaaagcctttttttttttttttactttatttcttactgtacctccatctttatcaatctctaatttttccaattccttctctaagtatcttgttttgaagtctgtatttcccatgtatgatagtctggaatttatacaactctgactcctttgagttgaattcttatgttcttgtttggaaatggcccccagattggcacagcaccagtaagagtgggatgccagcttaatcagctatgcatttatctgtgtgatctgcacccacagttatgaacagctgagccaaccaaatgtagttaatgtcatcccttcataattattctctaatcatgacctgctcctctccagtcttatcaccttggtgtctctgaggataagtgaagatctacttgggggtagaacttggtttggctcacttgcccaaaactctaacaaagttacagagataccagtatcagctttcccattgttatctaccactagtgatagtatgtgcaggtactattaactagaaactgatgttcaacttaaaataataatgtccacttcaatcaaatcaccgggtgaagcaatgaattcacctttgaaggactaagataatgtgtgtgattccccttaccatctcttttcccatcttatacagactagaaaacctgttgtgcatgtttttaataaggcatcaaaaaccataaacttttctttttcttttcactggacatctgtggacctaatataggtattctgtagaacacacacatgccagagaatgcagtgagagcaaagcaatatgatgttagcccaacccacaaattggtgtgggagcctttggaaaaagtatagcctgtcactttcagttatcgaactaagagaccataacaaacatctgagcagctttgagttttctgtttttgaacaagacatttcagagaggttgtgcaaagtatatactaaaatgcatgtattttaacttgtctaacataatcttgtgactattttggtgtaaaacactcttagactacttgggattttctaagagttgaacttcggaatttttagaacatggcttaaaattcaaaactcaaaactataaatggagattgtgacataagggattgaaaagggtgagaatcattctgaaatgtgtatagtcataccatcatgattctagatttcaggaacagcacctcatttttaccaaataatagataaatatgaagcctcacctgcaccacagacctgccctgtatagtcagctggccagttgactatggggtacacctgattaaaggttccaattttctgcctccagtctaccttcagacttaagacacaaacatcatgcctggtgccatttccctcactctgcctctcatatcatagtttctcacacccctttttacttagcaatgtgatagagaaggaagacaaagaacaattgttggtgactcgtaatatatcagaaattgttacatgttttattcggttaaatcctggggcaatgatgctgctgctgctgctgatgatgatgatggttttatagataaatataaggcttagacagtttgcagatcttgataaagtggaatcaccaatgagttttgaagggtgaaaacttgcacaaagtcacacagccaaaaccggtactcttgtctctacaactcagtgcctttccaccacactaagttgcttcccagggtgtctgtctgcatctgtactcttccttcgatttacaacagcagaagacccactaaaagcagagaataattggcaaagaactttgcacatagcaggtgttccacgtttgttcaatgaatatcagatataacttgcaagataaaatttgttttctcagagatgagcatagctcagtagcagggtcttcctctcctctccagcctatatcatgcagaccagtctgggccccaacgtggtcactaattttatgtgtcatcttggctaggctatggcacccagtactctggtcaaacaccagtctagatgttgttgcaaaggttctttttagacgtgattaacatttacatcagtagattgaataaagcagattaccatctattacataagtgggcctcatccaatcaaatgaaggcttaagaaaaaagactgaggtctcctaagaaagcaggaattctgccaccagactgtcttcagactcaagactgcagcatcaactcttcccggaatctccagactgtcaacctgccccacaaagttcacacttagcccctacaactatatagatatagatatatacatgcatatgtatataagtacatgtgtgtgacatacacttacacacatacacatgtgttcatatgtgacatacacttgacacatgcacacacacacatcctactggttctgtttttttggagaatcctaatataactggcataactttcctgctaaaaaccaaccagtgtttttatagaaggccagagaatgagtataggattagtttatcccccttctcataattaacttccctgtccccttactccatggatggaaaggaagtgggtgtgaaatgcttcctgaggatgagcatcattctgcattctgatgcaagcatagctgcttctgctgcctttgctaacttcacaggggcctgacccaaaagccaaaaaggccatgggtttatattatctatcacttcaatttaagttatatgcctttcttcctgaaagtcacggagtatctggagatgagaagttgcctctattagaaaaagcaggttttagatagcaaaacccactctgccagaaattctttgttgcctcttagtaactgttgttttgtaccagttcctcccctgttgaaatgtaggtatgcattccctttagcccttttccaggtatgttaagattggattatatttcattatcagttccaagaggactatctgttgatccttaaaggagctgccaaagaaggatgggctttcctcttaaaattttagaccttttgcttactctaaaaaataagaataatacaggattgactagaagattggtcactcttccataataagattaaatattccaattttcaaagaatagattatattttctaatgaaatttaatagtaaaatccaatgatactcaattgccctcgtatgtgtccagtcattgctcatgatagaacttttgttaaaacatgaaaacaatttaccatcttgtccttcaatccctcctccagtagaacctccttcttaaaatattttaatgctctgcgtgccctgtagaataatatcagaagtctttagggtgctatgtaaaggtcagaaacaccaatgctcgtgggactagaggcaaggctgggactgaatgtgagacgaagaggccagggacaaactgggcagtgcgcatgtcatccactgatactgtgttggaattagagaatgatattggaagacactccaaattttctagaaagcttggaaatccctattttttcatgtagaggtttctaagttgtaaatgttgacagcttattttttaaaaatactagccatgcacggtggcacatgtctgtaattccagctacctgggaggttgacgtaggaaggttcccagagcccaggagtttgaggtccccctgggtaatacagtgagaccttgcctctaataaataaataaataaataaataaataatgaatgaatgagcgaaacaaacctcatctaatttccaaattaacccttggattcctgtttccaatgctagactctgacctatgtccgcccgaaaggcttcatctctcactctgcccccttatactcacaccctgtgctctaaccacattccaagaacggcagctctttgaatgtaccacactggttcctactttggtgcccttcaacacatgttgcccagccctgccttcactacatgtccaaaagcccttccttgttcccttttcttgcctgcaaatacatattgcacagttcagctcaagggcctttcttcaaggcatccctcacccctacccaggccaaactcaccataccctaccttgtcaccccctatcccaaaactgtatataacgtccttattatatctataacatttggctcttatttattttctttactcctcctaaaagactctaagttccccaaaggcagagacagtatcttttcaatctctattctcagcacctcatgcagtagctagtataccatcatcatcatcatcataattaacacattcagtacttaccatgttccaagtgctttacaagtattaacttgaactctcacacaaaccctggataatcaccctaattttacagatgaagaaactgaagctgagtgtcataagcttcaacaccaaatagtgtagagtcagagagtatgggtctagaccttgcttctctatcatgttttctcccatatggcacagtggttttgttttgttttgtttttttgtgtggaaataaaattaaacctaaggttcatttcctagtagttgatcacttcagtatttccaatctctttcttatgtatctttcagttgctaataaaatagaaagctcagagatagttttgccaagaagaattttattaaaatactgccacttaaggactctaatcccacccagccctcctgaattcatctggtcttgattcagccttggtgaaaacagggtgcagtctgacctaccgataaccccattaagcagtttcttttgatgcaaacagcaatttaagcaaatatgcccttttgttttctctagagctctttcttatcgtagtaatatccaagctgagcttcatgtgggaaatcaaagagccaaagacagggacttttcattatacacagaaatccgacggaatgctttttattcccattcaagcagttactacttatctgcgtgactaaggtatggaagatctaaaaagaaactaagtgctagtctggcctctactccttcacccagatggaagtttcacaagcacgtttaaagcttcgggtcaagtgctgtcactctcaaaaaccagtgggtctgcattttcctttgcactacaagtactctaactacagacattgttccggtttttatctgattataagtatccaactaaagtagttaaatgtttagaaaaggtaaataactgatagtgcataagggaacctgaagtactctgttgacacttaaattatatagccaaggacaatggaggaaatcatttagtgctattaatcagtaatctaacagtattgtgtctgtgtgcaactgtctttcttttggctaatatctgtgaattaattggtcattgaaaaatctgataaaggaatattctaaaagtacacagtgaaatccaaattatttctatcaattacagctcaccttttctgaggcttaaacttgacatgtaaaaacattttagttatctgtttcaaaatgaacaatatacctctggttaaaattctaccttttaaaaattaaggtatttgagacctacagggattaattctctacttaatatttactttactttagtagtttttctacagaaagtttgtgaaagatttcatcccctatatatgtttctttatcctccaaaatctggtcctacaactgtactccttgacccataaggtcaagtggtgccatctgctggtcataagaagtggtgtcatctgctggtcattggtatataactatgagaaaaaccacgtgcactgttgtagaagcaacttaagtaaactgcagtagagtacacttaccactttagaattaacctttaagttataacttctctctttcccttccccctttctctctcgcactttctcttatgaagccaatatgactcaagttttagactattttaaaaggcaggtttgagaaaaaaaaaaaagaaagcaaacttttgatgccccctggtgttcaggttccttagcatttctgaacttcctcttttgctaaaactaaaaccataataatgtgttcttcattcattcattcatttagtcattcacttattcattcatctaatgaacataactatatcatgaacctatgaattacactctatttgagataactggataccaaattgtggccaacatgacaaggaaagaaaaatgaagaatctcaagacaaaattcaattgaaatctgttttgaagtgtcctttgagtttgtcagttcagttgtagcaaatctgtgatggctgcccttataagtaacctgaggaagagaggaaaagagggtagaaggtgaagggaagagaggggaggagggagaggatgggctggatcagtgaacataatataatccactcatgacacacagaacagacaacttgttgcttcctctttaagtgcattataaactaacacttttttttttttttttgagatggagttttgctcttgttgcccaggctggaatgcaatggcccaatttcagctcactgcaacctccgcctcccgtgttcaagcgattctactgcctcagccccccaagtagctgcgattacgggcatgcgccaccatgcccagctaatttttgtattttttagtagagacggggtttctccatgttggtcaggctggtctcgagctcccaacctcaggtgatccacctgcctcggcctcccaaagtgctgggattacaggcggaagccaccgtgcccggccgacacttttaaataaagagataaatgagcttgatgggaatatattactttacgagcaagatttgtgtctaatgctttaacttaattgtggcaattattgtcagatggtctaggaaaaaattgtgtatctggtacatgacttttggggagctctaggaagccctcagcaacatcatatttccctttgcacacctctgctccagagatattttcacagttggataagatgcttcttagatgatcaccaatactccatgcctactcatcagtccagccacttgaaacaatcaccagtacaacaggaccgccatatctccatgatatgaaatgaagagctcatccacgtgccaggaaggtggtgcaccccagctgaatgggaacagaagttcctgtgctcaggacccttctagacttcactttatgtatctttttatctggatatttattcatatcctttcaaatacccttcataataaatcagtaaacgtgtttccctgagttctgtgagccactccagcaaattaatcgaacccaaaggtggggggaggaggttcacgggaaccccaatttgaagccagtcagtccgaagttccagaagcctggacttgcaaccggggggaaggaggggatgggcttgtgggagtaagctcctaacctgtgggatctgatgatttatctgggtagatagttggaattaaattagaggacacccagctgggtcctcctgcagaattgactgcttgcttgctggagggggaaaataaacacatatttttggatcacagaagtctcctgtgttgattgttatggtgtgagagcacaggaaaaatggtttgagagtttttcctaaacaacatgatatacacgtaccaaaatatcactgtatcccacaatacatacaattattttgtgccaactaaaaataaaaggaaaaacaagaatttaaaaatcctagcatggtactggcataaaagcagacatatagaacagtggaacccaacagaaatttcagaaataaactcctatttgtggtcaatgtagttttgacaaagatttcaagaacacacagtgggtataatgacagtctcttcaataagcagcgttggaaaaactggatatccacccacagaagaatgaaattagaccctcatctcactccatatacaaaaataaactcaaaatagatttcagatttaaatgtaaagcccaaaactgtaaaatttctaaaagaaaacgtagaggaaatgccctgtgatactggtctgaacagtggtttcttggatacaacataaaaagcataggaaataaaagaaaaaatagacaaatgagactgtatcaaacagaaaaatcttctggacagcaaaggaaataatagagtaaaggaacaacccaagaattcggataaaatatttgcaaatctgtcttctgataagggcctaatatccaaaatatataaggaactaaaacaattcagtagcaagaaaacaacctgatttaaaaaatgggcaaaggaccaaagtagacatttctcaaaagaagataaatggccaacagatacatgaaaaactattcaacatcatcaatcatcagggaaatgcaaattaaaatcacaatgagatatcaagtcatttctattagaacggctattatcaaaaagatgaaagagaacaagtgttggagggggatgcggagaaaagggaacccttgtgcacagtggtaggaaggtaaattagtataatcacttcagaaaacagtacaaagtttccttaaacaaacaaaaatacaattaccatatgatccagcaattccacttctggacatacatccaaagaaaatgaaatgagtatgtcaaggagatatgtgcactttcatgtttattgaagcattgttcacaatagccaagacgtgaaatcaacctaagtgtccattatgaatgaatggataaagatgatacacaattgaatattattcaacctttaggaaaagaaggaaattctgccctttgtgacaatgaggatgaaccgggagaaaattatgctaagtagaataggccaggcagagaaacacaaatactgtactgcatgatcttacttatatatggaatctaaaaaagtcaaactcatagatgtagagagtagaacggtgcctaccagaagctggagatttggaggtagtgattatttgaatggggaaagggaagatgttgatcaaagggcacaaagtttcagttagacagaaggaataagtctgtgatctattgcacagcatggtgactataattaagaataatgttttatatatttcaaaattgctaaaagagtatattttaaacgttcttacataaagaaatgctaagtatctgagatagaaaatatgtcagtttgatttaattattctataatgtgcatatatgttcatatataacatctcctgaatatatacaattcaggatatatatatatatacatatgtctcctgaatatatacaattattgtcaattaacaataaaattaagaaagatatagcaagcaaaaaatactcctcttccactttccctcagtactttacaaatacatttcccactgcattcttatgaagtgctagtttagtaattagtaagcctctttatacttcaccctcattttaagtcaccgtttccatctattttcctttactgaaatctgcctatcctttcactctacagctttctcttaaggaggttgttatttttccattccctacatactaggggactgtgatgaagggtagcaatctcctggtttctcattgccaactccaggttggtttgcttccatggcctctagaaaaactaatgctattagaaggtggtctcttccatctggctctaccatcctctgatcatccctgtggctttgatttaccagcccctccaacagctggaccttgtatcatggtcttcgtcttaccccaagtcctatctgccacagttctaggagatgtaatatgaatgtagacaatacacacatggagatttaaaaaaaaacaaaccaccttccccctttcccccatctgactaattcacttgctcacttcttggatctttccataacctttagaacttattactcttctaaaaccttgagctccgatatctccctccaggacctcctctccttccctctttcacattccctcaccctaccctcatggctcttagactcctttaagtcctccagtcccttgatcctccacccccttgatcctccaccttcccccatcatccaggtccttcatggcttcattgttccccacagggctggatttctttgattgataagataaacttatacttccccaacatcctcaattccttgaggtcctatctgatcagacaagggtgaagggctgtcagaaaaaattacacgcccttgcagattggtaccatttctaattcatggtccctaatctgacatggtcaaatctttgtcatcttttctcaaactcattatgcaacccttatctcttactttgttaagaaaattataccatcaagagtcgtctttcttaggttcacagcacctactcttaaactatctagaggccccattcttacctcctttcttccagccccatgtctccattctaatagaggactatgatttctgtcagagcttctgatcccattcctctgggatcttgggccattagccatacctctcttagtgtcttccattttttcttctttgtgaacttcttttcacttgcttacaaacacgctcaaaactctctccttagtaaaagaaaaaaaaaataccccattgactacctatcctctgctgttcatctcccagtatctcctcccttttcatccagactttatgaagtacaggtttgttgtttcttttcctcacccacaggctgttcacactctctccaatttgccagagtttcgctcttgaggcaatagtccatgtgaattttgtattgggtatttgaaaaaaaaaattccggagtaaaataagggtgagagctctgtgtgtgaagaagtatttaaaagctatttgggttttaaattgtattaaaagtcagaaaatttaaaaacaagtcttccttaagcatttctgttcaacttacaaatctttttatactgtttacaagttgagtataatgagaaatatcacctttacttttttattgattactgtattagctatttttggattaacatttctaaattgaacagaataattttcctcaatactttaattatattcgattaaatattttaaacagtttttcaaaaatttgactttaatttttaagcatttcaaatgtctgacaggacaaatttacaatacctataaacaaaatgtttccgagaactcagataatgcttgaaataaaattatttatactcaggaaatataacaaatcaaagtaccttatataatctgataatatacggaaacttagtcaaattatttttgccttttagcttaaaatcaaacttaaaatcaattgcatattcaattggaattatgaggataacctctgaaattctatgtattttatatactgtataaagttttaaataagaaacagagtttttctttaaatttagcacaaatgctatgtttgctttatttcgacatttctatatttaattcaaaaccatcccatggtggaaaggcacttacctagagtgaccataaaatatatcttctaaactgggacacatttgagagggaaaaggggaacactaaaaataattaaaacttgttaattgatctacagtaggtataaaccaggactatcccagccaaaccaggctgatggtcactccttcctgatccaagtgtagggaatcacttacaatttggacgagcagagctttgtgggtcaagtgtttatgctcacaatatggctatataggtcagagatgtgagtgagaccagacataggtcctgagagcgatctgcttcctcagtgattccatctgtgttgcagggggacctctgaggttttttataactgttgcatcaaccagggacttcaagtttacaccatcaaagtgattttgtgattaattctttctcactttctttattgcctgatttgggtagatagaagttaccaccaccatcatcatgggttgcttttaatgtttccaagaggtcacaactctaaagtcacagggatgatcagaggatggtggagccagatggaagagaccaccttctaatagcaaagtcattttaatggcatctcattgtctttggcatttccttcatcctatttttctggctctgaaacaaatttttgtttttgctcaggataaaggtcattaacaacttcttaatcaaatctaatcgaatttattttttcttagtattaatggaccacatgattcattatctaaatgactgtctcctgcacttcaatttccttcatacccaacttccccgctaacaacacacacacacccctcacctctctaatttcttagctcatcccttaagactcactttctccaggaaaactctaaaagatgcccagctctgtgttttcacagtatctaaatttacccttatcacattgttttataatatttgacttctctttctgactcttctcaccagatcaggagtttcttaagggctcagagactatatagatcatacatctttccctcttagcactaagtttaaggaccagaacatgatggtgtagagaaactttcccgttggagacagggcatacaaatttatttcatgtgaacacatgggagccttcagaatgaagacccaaagatccagggaaaattttccatttttatgattagctttgttaacccaaaatatctgagacaggtctcagtcactttcgaaagataattttgcccaatgttaaggatgcatcggtgacacagcctcaggtccacgatcggccttccactgcatacacaatttagtctggttcagtgaatctgcatttttacataaacaatagggcagagaaagcaatcagatatgcatttgtctcaggtgagcctcagagggattactttgagttctgtctgtctttcgtccacaaggaatttccttgggcaaattgtgagggaggtatgtagcttcttatatttgtagctatctcttccaggaataaaacgggaagcaggtttgtctaacatagttcccggcttgacttttcccttggcttagtcattttttcccttggcttaatgatttatattccacaggttcaacaaagtatggacagccatgtagaaatatgattggacaaaaagggcatgacatactgctaacagactgagtggggaaacccagcaaagctgtctgtctagattcttcttggcctctctgtgtaggattccttccttatgggtatgagtcaggtctctctctggaatgggggtattataacccacagtcaaacaagataggtcagacaatttcttcatggccatattcgcatatcttttggttcttacccttcacacagaaaggcagagggaaggttagagaaatatgtttaggttttacggctggctttagggaaaagatcttctggtttctattatccaccttggggaagaaggattctagtttctatggtagcatcagggggataatgggcgtgaaagacaggcaggagaaggtcagagaaaaactttcgcttttgaggctgcttctgaggacttcctttttggggtgttgttatctgaatctcaacagtggaaaaaataataattaatcaagagtttagactttgcaattaggacagattcaggactgaatctcaattactttagttatataaatttgagaagacttcttaaatgctctgagcctcatgttcctcatgcaatgatagtgataataacaccaacacttgtcctttctcaaacatcacatcctacctagaatttaattatctcaatttaaggcttaatacctgtaaaattcataaacccctgggtgaggtaacattttaaggtgattttggcaacttaacaggtttgataggtttgattgacattttgatgggctagagagagggaagtcctgaagattccaaacggacaaggaagctttggggagaggcaaataagcagaaaagatgaagttacagcaattcaacttctctctctctcctcctctgtaaaatggaaattacattaatagcaatgacattaatatctgtgaggattaaatgaagaatatgtggctcttaataaatattagctgttttgttgttgctcttgaagatgctcagaagacaaatatgactttgttcccaatttgtttttaggattgtatgtacagacaacatatggatttgccagagaagaaaagcaatgcttttagacttatttcctgccttaagtttttaaagtggaataaagagcagtgggtcacataagagctcattatatgggtctttcatcatagctttagatcctgacacgctaagcagagattatgttgcatctgtgatattaaaatacatctgggtatctattactttttggcccttttctatacaaagcacagaagctgagaatcatgtctcttcagatcaagattgaacatactctctctttcactgagggaggtatagggttcagggcttaatcttacactttgcttatcctataacagaaataataatacctattattatttataataggtatgtgaagatcctgggagtccagggtagatggccattctgttaacctgaatatgcttttaatgtgcagcattaatctaagaaaagtgaaaaaatggtgagattttacttcaaaaaatccaaattatatgcaacttaagtcatcttcagtagagtttcagaaatgataggggagatacaatttgaagtgaactttgaagacaagacaaggtgatttgcaatgaaggatatttctagggtaaaagggactttgaatagaaggaacgaataaagaaaactgaaggagaacttgattctattgcaacaagaaacatatggctaattccaactatctggagcataccaactttaaagcagactgtcaaaactgaccctacttaactcattttaaagcatggggttcttccctcaaccaaaaacacagatgccaggttacactttataactggactctccactttcattaaaggtcattataaggaattgccacctaaaatgtgatgtaaatattttttgagaaacctagtatatcacttgcaattccctctataaagtacctgcaataaatgcatttttaatattagatttcagtaatattttcttcacttgtgacatactacttattttgttttatcactatgataatgggagaatggaacacttctctttgttttttgttcttatttccttaaagttttagagtaatagtcacatactaacctataagaaatttagaaaggttcaattaggccttctatgacaaaaatatctaagtctctagttactaaaatgttaatgtttatgttgtatcatggtctatactgcagagtcagggtaaagacacatagctgtattttttagatcaataatttgttcagttatttacaatcaagagtgttaagagaacttggattgcagacaaatctcttatacatttatccaattatattcaatgttttttcagaagggtaccttaggactggcctggtacatacttgcatatcttttgcttcttaataaacactagccactattttcttttcagtacattttttttccttcttgggcaggataaagagaagttgattattctgataattgcctgtggagaagtttctttggatacaattttattaagggcattgagtctctgagtttaacttttttcttcccaatgaccacactgtgcacaacgatgatgttgtggattttgaacctgaatttataccagttcagacatctttggcttcttcatgctggcataggcttgcctggctgagaatctgaagatgcaataatttttaaaatgtattactgtcattattataattagtttacttattgttcccccagatattttttcaacaatgttctgctaaatctagagtggctgcttgctaatagaactttagctttttcacaaagcttccaatgtgggaatctaatccattgtcaaaagtagtggccaaaatgtccctactcattgtggctgtgatacaggtgtattgtaaaaagatgtgattcacacaccattggggatctctaagcacacctccatgttatttagaatttttattttggcccaaatatctacaaggtagtggggagttatgtgagtttcttaggccatgacaacttgccagctttaataccttcagatgaggatgggttaccagccagcttgggcccattttgtagtacccatccaggacagacatactggtcaggggcagaaatataacaattcagtgggaaagctgatatggttggctgaggtgatacatttcatgcatttgtgtgaatacttcctcctgaagatttgatgattctggaatggtttggagacgacttcaaaaataacatgtttagtaaaagggaactgtaggacactgaagaaccactgctcaagacccaacatagtcagctactggtgataaccatttcagtactttgttggctaggacctagaagttgggaagacatttatgagagattatcaaaaagggagaagctgttggaatccttatactgtttcataatcagaattgttgtaaggtgacctagttcttgataattatctttagaaaagcaagggtacaggttaacagagggggatttataggataagaacagaagggcagggcaaaatctatgttcacaaatagaccgactctccttgtcttgttgacatagtaatcaaaaagggagaccactgaaaatttttgcgtattcaaaattattgaaaattttgtcttccttttattttagggcttgttaagaaaaaacatgacccaaaatttggaaataaggcaaaaatattactgcctaccttttcaaagatactgcactaaagaaagcactgtcccacaggactgcccaagggttatccaagtctgggtagcaaggggtcgtctgattcaggcactaccctgagcggaaaacaatggcccaagacctcgaccaaacccagctctccacctgtttttgtacagctttgaactgagaatgcttttttacaatcttaagtggttgagaaaatatcaaaagtagaataatattttgtcacatgtaagtttacatgaaattcaaactttagaagaatttcctcttcacagacatcacatcttcaagagcaaatgcttgagccctaacctgcaagttatagtagaaaagtccagaagtccagcctggtcctcgccaagtttccaactcctatgcctaggggtattttatgcttacaggatctaacttggttacaacgtctaacttttagcagagaggcagtgctgagtagaaactggacttgttaaccatatcaagtcacttaagttggctaggatcccctacttaggtagcggccataaagcctagggcatccctgtgccctcaatggttcacttctgagtggtgggcttcctgctcctcaatagagcaatcggcagaaaggcccctagaaagctacattgtcttcatccgcgaaggattccctgtctcctattcctcaaaggagcacccggattctactttcattcttcttttgccattgcattttataacttaaaagaaatagatgattgtaacagaagaaagaaaactttacattgtgagaaaatttagacctaaagcttatagtaatgtgaggacgaaagtctatactgtttaagtaaataggttctatgagcagcatccaggctaacatcacacagtggtattttgaattaaattgtacttgtgttttgtttccgtgttttgctgctgtaaggaaagaggaaagcatcccctttctcggccctcctcccacgtccaggctaatttgcagcatttctacatctcagagtccacccttaagatccttgccacccattattttgtttcagaacgcttaatccatcaaggaaggttaaattggattaccccagtagggaagggacgggggctgtaagcatgagggattatccctgtaaagggctcgtggtgtgtgtgtgtgtgcgtcctgctagtgttgaatgacggagacctgagtttggattctgaatccaggtgtattcgatgccgctccggcgtagaacgggttaaagatgcccccagccaggtagagccagactgggagttgtgcaaggtctcaaccccctaaaagcggcccctcaaattgaagatgagtaaatcatagttcgtaaatcagaaagattatccagtactacgttactctgtttatttccctttcgtcatccctgagtcttgggtcaagtccatcccagctctgtcctccaggaatcaagggaaatacgcaaacccgcggtgggttcgcagccgcaggaaggacaaatcttgcccccgccgcggcggccgccccgcgttagctgcctaagagaatctccgtggccggccagtacccgccttggtgaggattctccctcccgcgagaacttctggaatgccgccgggccagattttgcagctgaggcctccgacgccactaatattgggccaagcagggagtgctgctcttccttataaggttttagcgaaagttaagtaagccaattaaagtgcaaaacacacagtctggaacaatacagcgctctataaatggtctccattattatcattatccgttagttataactggggataaaaaaaaaaaaaaaacgacaaaaacctggagaaccggaaaggtctgcaaaaggggcggaacgcgggaacttcgatttggggaaggggtggcgggggagatcccacacaagcagccaatccagctgtcccggggaggaagaggaggagtcaaggcccgcccctggtctccgcactgctcactcccgcgcagtgaggttggcacagccaccgctctgtggctcgcttggttcccttagtcccgagcgctcgcccactgcagattcctttcccgtgcagacatggcctctggcaccaccaccaccgccgtgaaggtgagatgagccctcccagccgcagcggttcgccctgccggatgccttctcgcccccgcgccgggggaccgcgcctccgggggccatgcgcccggcccgtgcgtcccttgccgccgcggggagggactggggcgcggcactcgggactcacttgccgcgcgaggagagggtacgcttgcaaatgatccccctgccgcaccgccaacacacacacacacacacacacacacacacacacacacacacacacacacaccaccttttggcttatctgcacccgcaccctgtagggcgtaggcacccctttagagagagaggtcgtggatgggagaggctgcacccatgccaccaccattcctgagaaccactcttcttccaagaaagacacccggctggagtcaggaggtgtccgggcgcctgcagcttctgtgaccgtctcctggtgccttgcgggactccagcttccgctctctgactctgcttgttgcctgcggcccacgtgggagaactgcttacttgctcttttgtatgcttccggcttctttttcctccaaacgtaggccttctccgcgctgaagttttccccagcagcgtaatactgtaagaattctgagactttcttcgaaaaggagtacaggcgtccgtttttagggctgcactgtttggaggcctctggcttgaaactgctttgttttgcagccttgcaagttagagttcaatttccttgtgccctaggccctgagaggccttgatacaaggggtcattgtgcggtgggaagctttgtgctgaggagggcacgagttctgagagtagcagctggcttccctggggttttaaacacttctctcctggttagtattccgagagagaattacagcacgtaaagaaaaattgatgataaaacttaagacctcttctaggcagtttattactggctaagaatgcgttcttgtttgatttttagaaatttttggcctatgggataggaaggtctgcgatcttctccaaagcatctcgattccctacactcgactgcagttttcccgggagaaggcgaatttctgcggtcagtgtgtaatcagccagattagtttattacgcccttgcaggtttaaatgagccacttagaatgagaggaatggtgaagggtgttgcatccagacttatatatgaaacttattttgtcattttgaaaagaatcttgcatccagcaaatatttatagaaggcctctcccctgccttcattgtttggcggaaacaaggcagaaatggttttcatgaaactcgtgtgaagtatgtgacttctcttaggtgctcatctataaactgagaattttactgcagaatttgctaggagggctagaattatattgtctatgttgcacatggtagaagcttattaagtggtagtgcttataagtgggggaactgagattaattttgaatgatcttttccccaaaaattattaagttattgtgttaggtatcattaggccacaacttttcaccttatccttgcaggaatacacttcaagcgccattaaaaatggagaaatggtgtttaaaacagtcttactttaatctggttagcattctccctgccacagggtttcccttcaaattaatgcagtgcatttaagtgcagaatgggcaatgggattctcagagacctgatgtaaatattgaatagtgtgtatttttggtcttggcaagcttctggatataaaattaagaggtacatatggtgctaggactgcctgctgatttctcttttaatttagaacagatgacagctttgccgtagagattccatgatgccagcaccgtattccccagacttctaaggcaacattctgtatagaagatgtgaggtgccagtgtccagagcaaaataggttaataaaaaccacatcctattcccaaattatagaatgatggggctggagtgttccttcaagaccatccatatagccacacaaacccgttttgcgggtgtaaagttgaggcccagaaaggtcagctaagtatccagaattacacagctggacctagataatgacagaattgggcctagagcctggcattccaccaactagatgtgaggcatttctgaaatctgaagtgtggtctctgccctgttttcttgtgacctaatgcacaattaaaatgagcacttgatagaatgtccatcttgaagagggaggcagagggtatgcagaaagcaggctgcctccagtgcccactgcacaccacccaggtataggtataggaggcacatgtgtgtctgaaccccattggtgtcactggcaggtcctttgagaggttgctggatttaaatacagtaacatgtaacacactcagcccagttccaggtactcctttaatgtcagcccaagtacctctcttcttaaaatagagatattaacggggtggatcttaaattcattctcaattttagaggtgcagttaactcatgcaagtgaaagattccactgagttttggattggcagtatatttggcatatctttcaaatctagccatctactggtggaatcctattcaaaaatatttattgaatacctgctagacaatggggatgcagctttgagtaagcgaggcctttatttattttcttcaagtttatattctagtcagggtgggaaaccaactgacatgaaagtgaaacagcagtaagattccattgggtgaggggtgtcagaaaagactcctagggaggtggattttaagctgtgcagtagtctgcctccaaaatctgtatgttgaaacctaatcgccaatgtgatggtattagaagatggggcctttgggcgtgattggggtcataaaggtggagccctcatgaatggaagcagtgcccttacaaaagaggccccagagagctgccttattccctctactaagtgagaggacaccatctatgagccaaaacgtgggccttcctcagacactgaatctgctgtgaccttgaacttgctaagcctccagactatgagaaatttctgctgtttataagccacccagtcctaagatattttgttatagcagcctgaatggacttaagctgatagtgaaaatagggataaagggtaaagatccaagtgaagacctgaggagagagatgggggtaggagagcgaaaaccaagatgtcgcagaagtgagctcagtgtggtaggaatggaaatcacggatgcacagtgagaattgggtggatgcagctcataaggccatccttgtagaccgcgatcaagaattttgattttaaatgttttggaaactgttgaagggttaagagtgggaggcagcatttgatttacattttaaaatgattactctggctgttgtatacagaatagcctgtgggcaggggaagagctaagagatcaggccagaagtcttggtgctggggctgaagtctagggtgggagccatggaggtggtgaggaataatcagattggggatagaatttgcaggtagaacacagagatggataagatgtggggagtgcaggaagaagaacaggatgatttctgcttttgacctggaaaaccaaaaagatgatgatactggtggatcatttcaaagtgggcgataaggggccacgagtgactccttggagccaaggagggtgagtgtaggattccttcctcccagatactgctggttagggggccagaggctgggatgctgaggggcctctttgctgtaggagcagagtgggtggcaggttgagggagggaggaagccacctggagtgagagtaattcaagcaatcttttttgtggttcactgcagtgagagatggtccaggcagggagtgaggatattacctggggggtagccatggagagaggcagcaggagccagaggctatgggattaacactgccattgtctgagaggacctcagggagacattgtcctccagcatcagccaagggcaggtggtattcctgacagagggccaaaccagtctttggcacccagatacagggcattctggagggctcctgcagtgtaccatggctcccctgggcagcctcccagctttcattctgggagattaaaaataagacttggccaggcgcggtggctcatgcctgtaatcccaacactttgggaggcccagctgggcagattacctgagctcagaagttcaagaccagcctgggcaacatggtgaaaccccatttctacaaaaaatacaaaaattagccaggcacggtgctgcacgcatgtaatcccagctactcaggaggccaaggtgggcgaatctcttgagcccaggaggcagaggttgcagtgagcagagactgcgccattgcactccagcctgggcgacagagtaagatcctgtctcaaaataataataataataacaacaacttgttaatcatggttgctgtgacaaggaggggatatggtcccattgtaggttggtagtgagctatcaacataatgatattaagggagatggacaagtcatggtttgtagactgtggaatatgggcctttacactccctgctttgctgtcttgagtgtggcctgcaagggccttcagcctgagagtccttgtgtggctatctgaaactgaggacaacctgcaggccccagttgaaaatcacatgaccaacaagccttcattttttttgcctagggacacaagggcattttgggcaggacaattatttcttttgtaggactgtcccaagcattgcaggacatggagtacaacccttaacctcctccacagaaatgccagtagcactccccctagtcatgacagccagaaatagccctgtttccagatacccccaggagagctgtttgacatttagttgaggaccccaaggctaaatcccaaaaaagactacctgctgaagagaggtaggagcagccaggttttgtactgctcagcagagtaaaaggaggaaataagggctttttttgttgctttgaggaagtttattttgattttttatttttgccaggagtggtagggtatacagaaacagagactgatggtaatacattatttcattttattctcttgataattttatggattagtaaaaatcttaccctataggtacagctgaggaagcagttaaggaaaatgtttgtatgcagtggattctggatcctcacctgtggttgtagtcatggcattccagcctgtgcctcaaaagcatctaaagcagtggttctcaaagcgtgtcatgcattcatatcacctggtcatttgctagaaatgcaagttcataggccccaccccagtcccagtgaatcagaaactctggggctggggcccagcaatctaggttttgacaagccttagaatattcagatgtccaccgaagtttgacagccactgacctagagagctttggaaagggtggccatctacatttttaacaagttcttcccttagtgttatagtttcctgttgctgctataacaattttcacaaatggagtggcttaagacaacacacatgaggccgggcatggtggctcatgcctgtaatcatagcactttgggaggctgaggtggatagactgcttgagctcaggcgttcaagaccagcctgggcagcatggtgaaacctcatctctgcaaaaaaaaaaaacaaaaaaattagccaggcgtggcggtgcacgcttgtagttcagctccttgggggctgaggtaggagggtcacttgaacccaggaggttgaggctgcagtgagctgagatttcaccactgcactccagcagcctgggtgacaaagtgagactctgtttccaaaaaaaaaaaaaacacacacacacacacacaaacgtattctcttacagttctggagtccacaaatccaaaatgagtcttacagggctaaaattaacatgtgtatcgggctggttcctcttagaaaaaccatttccttgcctttttcagtcttctgaacctgtagaaccatgagctaaataagcctcttttctttataaattaccctatctcaggtattctgttatagcagcagaaaacagactaagaaaaatgttgtgcttgtaagagattgggacacggacacatacagagggaagaccatgtgaagacacatggagaacgctgccatctacaagccaaggagactgaccttagaagaaatcaatcccaatctcaccttaatgttggacttctagcctccagaactgtgagaagataagtttctcttgcttatggggaaaacctatttccttgcctttttcagcttctggaggcaccagcacttcttggcccatggccccacatcatgtccccttttctctccctctgcttctatcattatatcactttcttcctcatttgaccttcttgcctccttgtgatttcatttaggtcccacccaggtaatctaggataatctccccatctcaagatcctggatttaatcatatttgaggtaacattcccaggttctgggaattaggatgtagctaggatctcttgggacaggggcattgttcagcttgccacactcagcccacgttttaaaaatttatggtctaggggccgggcgcggtggctcatgcctgtaatcccagcactttgggaggctgaggcgggcggatcacaagatccgaagattgagaccatcctggctaacatggtgaaaccccgtctctactaaaaatacaaaaaattagccgggcacggtggcagcctcctgtcatcccagctacttgggagactaaggcaggagaatggtgtgaaactgggaggcggagcttgcagtgagccgagatcgcaccactgcactccagcctgggcgacagagtgagactccgtctcaaaaaaaaaaaaaagaaagaaatttatggtctaggccctagagcaggttgcttagttctgagggcactttagaaccacctgcggagctttaaaaacaaactacgccttgcccaactaatcagaatccctgaggcctgggctttggtattgaaagctagagaaggggaatgtcctagtatccagcagctggttcaggagggtgggtggctcccactgttgctccacaggcaaaggagagctctaacaaagtatgcattagggagagtcctcctctaaaaatatctggccatttcagcaggtgaagtgtgtctttaagagggtgtctgccctttagactgatatctgtacttctcaaggggcatttgctcaaataaaaaccatggatgttttgagcgcttgcatcatccaagcttctctgactaaaatatagagtcactgtattagttcgctaggcctgctataacaaagcactacagaatgggtagcttatgcaacagaagcattatctcctcacagcgctggaggttagaagtccaagatcaaggtgagatcaaggtggatttcttgtaaggtcagtctgcttggcttgtacatggcaatgttctccatttgtcttcacagggtcttccctctgtatgtggttatatcccaatctcttgtaaggacaacagttttcttagtctgttttctgttgctataacagaatacctgagacagggtaatttataaagagaagaggtttatttaaaagaaatgaaagggagacgagggagataggaaaaggaaacaaaaaagagacaaactttgcttcataacaacccactctcactggaactaatccaacccaatgagagcaagaacaccctcccctgggactgcatgaatcccttaattggggtggattattaccatggctcatgactcaaactcctcttaaaggtactacctcccagcatcactatatttggggaccaagcctcaacatgagttttgaagatgaccacattcaaaccataacatgaggtatactgcattagggcccatcccagtgacctcatttgatctgaattacctctttaaaaacggcaaatacagtcacattctgaggtactgagagttggaacttcaacctatgaacttaggggagatacaattccatccataaccattacctacaagggtggcctacagagggggtgtcttgtcagagatggagaccccagctatccctgtggaccctattgcaggtttttaacagtcctcacagcctgagacagttggttgctccctctcatacagctaggcttccaggattttgcaaggccctgacaggcctcaaagccatgtcagcctaataatgagggcctccgtctgctgtgcttgccaaaattgttatggcaaccagagctaaaggactgcagtgctcagatcgggctgtgccagctccagctctggctcgcttaccttatcgtgagcttgaggcactcagaggcagcccatctccctggcatgagctagtctcaaccgcttggggtgatggtattttgaaaatgccattatagagtgctgggttccttacggcagtgtgcccaggcctcaaagtgatggtgaatggtttctgggacaaagaagggttggtaaaatctcctgtagccaggtactagaagaaatagacagagtaggggttactatgcaccctttccacattgctagaagtaactgttctgaccaggtgaactggtatttggataaatgctttcacagtctcagagaagtcagacccttggattgatttgctcttgaacaaaaaaattttttttttcactgtgaaaatgctttctttggggtgtctttagaacatgtgatgtcaagacacaacagcaagcgcacatacactaagacatggctgtcatagaacagattgtgcgtgaataaagggttcacaccacttccaccctttacacagtaacagaaggctctaggccacctacctcctccttggctcactcaaactcttcctcctcagccgtggcctcctgctactgctggtactcagacaccaggtcgttcatgttgctttcagcctcggtgaattccatctcatccatgccctcgcccgtgtaccagtacaggaaagctttgcaccgaagtatacctgtgaactgctctgagatgcccttgatcagatcctagatagcagtgttgttgccagtgaaggtggccggacatctttagccctgagggtgggaagtcacacacagctgtttttatatcttgggggatccaaccaacaaagtagctgctgttcatattttgggcattaagcatgtgcatgtccacctccttcatggacatgtggcccctgaacatggcagctaccattacgtagcaaccatggcagaggttgcaggcagccatcatattcttggcatcaaagaactgccaagtgggctcacgcaccatgagggcccagtactgctggttgtcccagctggtcagcagggggaagccatacatgaagtgcaggtgggggaacaggaccatgtttgcggccagcttctgcaagtcagcattgagttggccagggaaatgcagacagatggtgaccccactcatggctgcagacaccaggtggttcaagtcactgtaggtaggtgtgggcagctttagggttctgaggcagatgtcatagagagctttatttattatcattgcagaaggtctagttttgagaagtttggtttgatggtcagtccgtggaaaagtgtggcatgagccactagcttttaaaatctgtcaaggaccttgattgactccctatttcagaactctatcttgtgtaataaagaagtcctggctgggcagaaattccatctcaggtcttgaacacatttcctacacagtctagaattaactggactgaggactgacgcttcctgcccaggaggcctggcaaggtcttgtcattgtttcctgagggtggatgaggtcattaagaaagagttttcctcccctctgagatgattcactcagatacctggagtcactgtttctgtgcttgttctgtgaccttcgtcatgaacttgacctctctgagcatgttgtctcataacatggagacaaataacttttctaataaggtataatgttatggaggactccaggggatattgggagagggcacatcatagtggttaagcctgaaagacctagatttgtatcccagctttgctccttatgattggcccctggacgaggtttttaatttttgtgcttctctttcttcgtttgtaaaacgggtaacattctatagggcccatcttatggtcctgatgatgaaataaggtaaggccactgaagcacttagcacagtgcctttaacatgtaagtccacagacacagttactttataactaaggcagtactgagttgacacaaacttagagactcaaaggaatgtggatagaattgggccatcagtgcttgggtacttcatcccagttgtactttgctgtggagccagcaggtggcgacattggccacatcttggccctgctggcctccatcttagaggtccagtttcctgggatggcgggactcagttgctacacttgtccctgtatccctcgcacaatgtaggtttccgtaaacaactggacctagtaaagtgactggatgggcttgcctgcagatcattccagagcagtagccactcttgctttcatgtccagggctactacatgttccttgctgagggctgagttgccagctacctggtgcagagtcattatgcagccaggtggtgcagactgaagcttggggttgctgagagtgagctcaggggctctgaaattcagcgggacacctggttagcatttctcaacaactgctacaatgctgggcaagttcacctaaactcagagggtggctccaaacaaagcccaactcgatttgtgtatttgatcccgagcatccagtgttgaatccagaatctgagatgccctggctcagggaacacccagaaacagccaggccaaagtggtgataagttaaaaagctagtagctgaatccccagggagctggctgagagtaatttcagagtcagcagttcatatctgtgtcccaggtgaggatatgggctggatggtttcttagcctcctcatgacctgtggtgcttcagaggtccacggaatgaaggataagatggagaagccaggctaaggaaggattgggatttcctaaaacagtatgaatttttgttattttctattgaagtgccgtaatttaaatgtattgacttaagtgaacacttctgttgatttgaaagctataatactggttactctttgttcgttgacataaaagtatgttaacctgctgtggttttaataatatacctccacaagatggcgccaacatcaaagcctggctttgccacttaaggaaattgtggtggacagtcacaaattatgtaaccatgtcatgggaaacaggcagagttcttcagtaaaaacctcactaaattgtccttattttcttgtttgttttttgttgttgttgctttttttgtgtgtgtgttttgtttttttcaggaaactgagccagaaaggtaaccatttttttacgtgttgataggactcaacttgtgtaacctgacctgaaaattatttaatgcagatgttcactgaattcttaatcctggaatttttttcttgaggcctactttattttatttagttacccttgtgacaatagatttaaagcttttcattgaaaaacaacaatgctcaggtcacttcgcattaattaggtttctaataaagttagcctggcactgtttactctctaggaggtaccagcccaaggaaatttccctaatgatttgttacttatttttagttttaacagtttagttaatttttatttatttttgtaattgttcttgtttgtctttcttaatcatcaaattagatcaactctcagaggatagtgctaggtttctttaactcagacaaggactttcaagataatctctgaaaaatgcaatacaatgcatgaacttaaaaaaaacttataactaccttttgaattatttatatttgcataaatgtatttactgagtaatatacatgagtatgctatatgtatatttacaacatgtaaatatgaatttgcatacatatatgaatgattgttttcataaatgtatatgcgggtaacttttcatgcaatttcagtctcctctgtctgcattctctcctagctctgtgattctaatggcgtgggaaagataatctctcatttctttatcaaatagaacagtgaggagaaatcaataccaaatggaatacctaatattttatatcccagcagtcttctgaacattgtttattctatagtccatttgacagagaaacaaaattgatcagaaggtactttccactaccatacttgcctacttttaggtttgattttctaccttgagttggttaaaatacctctctatgctgacttgtaattcagacagtcagaagtaaatgtgatgtagtccaaaaaggtgccctacgttttggttacttatagaatatagaaggccttcaaatgtttgttgatttttatggaaggctttgaaatatttgttgattgatgttcagtaattttcagatttcaaaaaaataactagggcttggcaggaatggagaagagcatatgaataaatgaatttgcttagaatcttatttctaataaaaattaccaaatacaataatcttctctgtctttttctctcttagattggaataattggtggaacaggcctggatgatccagaaattttagaaggaagaactgaaaaatatgtggatactccatttggcaaggttaatatccaacttgtggagacatgttttttagttttttcatttctccttgctggcttgatttttgaattaaaaaaaaaaaaaagaattgcttttgttttggcagcccagggctgtctgctcccagcagagagggccagaagttctgctgttgggttccatcagctgagaaggtgtctgatgggcgcctcacactttgatgttttgagaaaatggctacttagtatgtaaatcacttctcattctgttgctggaaatcagatactcatttcagaccacagactcatttcagactgtacttttcaaatctacattcaaatcttctaatttgtggccaataggtcacaccacactaattaggggacaggctgatgactaataggatgaattattgttacgaagcggcatttgagtggaaagaattgttttggggaattagaacatacctgatgttagttgaatgtgtaactgagctagaaataaaatgctcctccttttataggagaggttgcttgttctccaagcccatgtcactcagcctaggccggggtgagggtgtctgcattctcctaattccatattgctacgtcctctggtccatctgtaagatctctctatctggctgtcccaaccaaaccctccttttcagctaaattcttaggttgaccttgtgtgctcccagtcctgcagtcatcctggttcattttcttaaacccctcggttctaagggtctttccagcctttgttacctcaagtcatttccatgatcatcttagacctggttaacacaagcagacatttccagtgctgaattcttagtgtcatgatggtggcttgttatcctttctgcctttcaccttcacacctgttctcaaacctgcccaataaccttgacacatctaaatttgaccagtctaccatcagagttccctggggtactcgttacaaatagatctgactaaatggtacctacacaggtgcccatggtaaccttgagtcctgtgaatctatgcctgcagagggatcaataagtaattgattaaatgattatattgataatcagatcttgcctcttctctaagttgtatcctcagactcttcagattccatgagtcctgttgtggttgaacaattataatttacatacctgtttttaaatcactgagttaaatgtcattttttcattgcatgcagccatctgatgccttaattttggggaagataaaaaatgttgattgcgtcctccttgcaaggtatggtattttaagctttttggatgttactactaaaggataatttaaatttaacttaaattctggaaagagtaaagatacaggtctgagcttttatatgttggcagaatcagaacatcttagtaacctttatttacaatgttttatttttggttaagttatattgacttaggagatcaaagatctcatgctcttgccccttacattgggaaagtagatcagatgactaaaatcaaagctctggttttagttctaactgcaagaagaaatgttttgttcatttttttcccccttcttataaagataaagaaaaacaatgcatcattaatgacctcttgctggtagtagttatatgtctgtgggaagtaggcttagggcttctgaagtgggttacttgtgtctgtgctgttgtttccttaaggaggctggtgctgctccatattacagaggaggccaagtcatttttatcccattgttagaagttagtcaagatatatgtatgagttctctactgttgtgtaacaaattaccacaaatttagcagcttaaaatagcacacatcatctcctagttcctgttggtcagaagtctggcacagcttagccagtcctctgcttggggttgcacaaggccccacaaggcatattcaaggactgagtccccatctggagcttgaggtccttgttcaagctcgtgtagttgtaggagaattcactccctagaagttacagggcggaggcctttggctcctagaggtggttcacattccctgccgtgtggcctgctccacaggctgttcacttgactgcagcttgcttcttgctattaggatatggcaaaggtgctagaagtcacctccatggttaagctgtaccttgcaagcatgcaggagtccggcaggagaatctcctatgcatgcttgcaaggtagagcctaatcgtgggagtgacttatagcacgtttaccatttttctattggctgaatgcaagtcccaggttcactgatcctttatacagagcatgacagtggggtcctcactagggtctgtctgccactctacatatttgaaacaggagtggcttctcagaatccagtgaacctaaattttagttttagttgctcactggactgggttctaggagaccccctgtgttagtctgtggtcattgctagagaatcacttaattttttctagactctaggagaaaacagttggtggtgtactcatcacgggttaacaatttcttctctccttccataggcatggaaggcagcacaccatcatgccttcaaaggtcaactaccaggcgaacatctgggctttgaaggaagagggctgtacacatgtcatagtgaccacagcttgtggctccttgagggaggagattcagcccggcgatattgtcattattgatcagttcattgacaggtaagcagtcatacaaaatgctttaggctattgtagctggtcattttcagctcaaatggacgacgcgtgggaaccggcagggcaactgggagggcagtgccacagactcgcttgctttttttttttttttttttttttttttggagacggagcctcactctgtctcccaggctggagtgcagtggcatgaactcagctcactgaaacctccgcctcccaggttcaagcaatgcttctgtcttagcctcccgagtagctgggactacaggcacatgccacaatgcccagctaatttttgtatttttagtagagatggagtttcgtcatattggtcaggctggtcttgaatcaggagatcacccgcctccgcctcccaaagcgcaaagtgctgggattacaggcgtgagccactgcacccagcctgtgttaagcttttcattgtgagtttttgttttttaattttaattgacaaatgataaatgtatatatgaggtataacattatattttgatatatgtatgcattgtacaatgattagcaaagctaattaacatattaccccacatatcatctttagtggtgagaacatttgatttttactttaacaattttgaaatacataatacgttgtcattagctataatcaccatgcagtataatctcaaaaacttattcctcctgtctaactgaaattttgtgctttgatcaacgtctccccaaaccccagcccctggtaacctttctactctttacttctatgagtttgacttagttagattccacatataggtgagatcatgcagtatttgtctttccatggctggtttatttcacttaacataatgtccaggttcacccatgttgtggcaattgacagagttgcgttctcttttaaggctaaatggtattctgttgtgtatatataccacattttcttttttttttttttaattgtacttttaagttctagggtacatgtgcacaacgtgcaggtttgttacatatgtgtacatgtgccatgttggtgtgctgcacccattaactcgtcatttacattgggtatatctcctgatgctttccctccccactcccccaaccccacaagaggccctggtgtgtgatgttccccttcctatgtccaagtgttctcattgttcagttcccacctatgagtcagaacatgcggagtttggttttttgttcttgggatactttgctgagaatgatggtttccagcttcatccatgtccctacaaaggacaggaactaatccctttttatggctgcgtagtattccatggtgtatatgtgccacattttcttaatccagtctatcattgatggacatttgggttggttccaagtctttgctattgtgaatagtgccgcaataaacatacgtgtgcatgtgcctttatagcagcatgatttataatcctttgggtatatacccagtaatgggatggctgggtcaaatggtatttctagttctagatccatgagaaatcgccacactgtcttccacaatggttgaactagttcaccttcccaccagcagtgtaaaagtgttcctatttctccacatcctctccagcacctgttgtttcctgacattttaatgatcaccattctaactggtgtgagatggtatctcattgtggttttgatttgcatttctctgatggccagtgatgatgagcattttttcatgtgtcttttggctgcataaatgtcttctattgagaagtgtctgttcatatcttttgcccacattttgatggggttgtttgatttttttcttgtaactttgtttgagttctttgtagattctggatattagcccttagtcagatgcgtaggttgcaaaaattttctcccattctgtaggttgcctgttcactctgatggtagtttcttttgctgtgcagaagctctttagtttaattagatcccatttgtcaattttggcttttgttgccattgcttttggtgttttagtcatgaagtccttccccatgcctatgtcctgaatggtattgcctaggttttcttctagggtttttatggttttaggtctaacatttaagtctttaatctatcttgaattaatttttgtataaggtgtaaagaaaggatccagtttcagctttctacacatggctagccagttttcccagcaccatttatgaaatagggaatcctttccccatttcttgtttttgtcaggtttgtcacagatcagatgcttgtagatgtgtggtattatttctgagggctctgttctgttccattggtctatatctgttttggtaccagtaccacgctgttttggtgactgtagccttgtagtgtagtttgaagtcaggtagtgagatgcctccagctttgttcttttggcttaggattgtcttggcaatgttcatggttccatatgaactttaaagtagtttttcccaattctgtgaagaaagccattggtagcttgatggggatggcactgaatctataaattacctatggccattttcatgatattgattctacctatccatgagcatggaatgttcttccatttgtttgtatcctcttttatttcattgagcagtggtttgtagttctccttgaagaggtccttcacaacccttgtaagttggattcctaggtattttattctctttgaagcaattgtgaatgtgagttcactcaagatttggctctctgtttgtctgttattggtgtataagaatgcttgtgatttttgcacattgattttgtgtcctgagactttgctgaagttgcttttcatcttaaggagattttgggctgagacgatggggttttctaaatatacagtcatgtcatctgcaaacaaggacaatttgattactcttttcctaattgaataccctttacatctttctcctgcctgattgccctggccagaacttccagcactgtgttgaataggagtggtgagagagggcatccctgtcttgtgccagttttcaaagggaatgcttccagtttttgcccattcagtatgatattggctgtggggttgtcataaatagctcttattattttgagctacgtcccatcaatacctaacttattgagagtttttagcatgaagggctgttgaattttgtcaaaggcctattctgcatctattgagataatcatgtagtttttgtctttggttctgtttatatgctggattatgtttattgatttgcgtatgttgaaccagccttgcatcccagggatgaagcccacttgatgatggtggataagctttttgatgtgctgctggattcagtttgccagtattttattgaggatttttgcatcgatgttcatcagggatattggtctaaaattgtcttttttggttgtgtctctgccaggctttggtatcaggatgatgctggcctcataaaatgagttagggaggattccctctttttttattgattggaatagtttcagaaggaatggtaccagctcctccttgtacctctggtagaattcggctgtgaatccatctggtcctggactttttttggttggtaggctattaattattgcctcaacttcagagcctgtttgttattggtctattcagggattcaatttcttcctggtttagtcttgggagggtgtgtgtgtccaggaatttatccatttcttctagattttctagtttatttgcatagaagtgtttatagtatgctctgatggtagtttgtatttctgtgggatcggtggtgatatcccctttatcattttttattgcatctatttgattcttctctcttttcttctttattagtcttgctagtggtctatcaattttgttgatcctttcagaaaaccaactcctggattcattgattttttgatgggttttttgtgtctctatctccttcagttcttctctgatcttagttatttcttgtcttctgctagcttttgaatgtgtttgctcttgcttctctagttcttttcattgtgatgttagggtgtcaattttagatctctcttgctttctcttgtgggcatttagtgctataaatttccctctacacactgctttaaatgtgtcccagagattctggtatgttgtgtatttgttctcattggtttcaaagaacatctttatttctgccttcgttttgttatgtacccagtagtcattcaggagcaggttcttcaatttccatgtagttgagcagttttgggtgagtttcttaatcctgagttctagtttgattgcactgtggtctgagagatagtttgttataatttctgttcttttacatttgctgaggagtgctttacttccaactatgtggtcaattttggaataagtgtgatgtggtgccgagaagaatgtatattctgttgatttggggtggagagttctgtagatgtctgttaggtccgcttggtgcagagctgaattcaattcctggatatccttgttaactttctgtctcgttgatctgtctaatgttgacagtggggtgttaaagtctcccattattattgtgtgggagtctaagtctctttgtagatctctaaggacttgctttatgaatctgggctcctgtattgggtgcatatagatttaggatagttggctcttcttgttgaattgatccctttaccattatgtaatggccttctttgtctcttttgatctttgttggtttaaagtctgttttatcagagactaggattgcaacgactgcctttttttgttttccatttgcttggtagatcttcctccatccctttattttgagcctatgtgtgtctctgcacgtgagttgggtctcctgaatacagcacactgatgggtcttgactctttatccaatttgccagtctgtgtcttttaattggagcatttagcccatttacatttaaggttaatattgttatgtgtgaatttgatcctgtcactatgatgttagctggttattttggtcgttagttgatgcagtttcttcctagcatcgatggtctttatattttggcatgtttttgcagtggctggtaccagttgttcctttcctccaggagctcttttagggcaggcatggtggtgacaaaatcctcagcatttgcttgtctgtaaaggattttatttctccttctcttatgaagcttagtttggctggatatgaaattctgggttgaaaattcttttctttaagaatgttgaatattggcccccactctcttctggcttgtagagtttctgccgagagatctgcttttagtctgatgggcttcccttgtgggtaacccgacctttctctctggctgtccttaacattttttccttcatttcaactttggtgaatctgacaattatgtgtcttggagttgctcttctcgaggagtatctttgtggcgttctctgtatttcctgagtttgaatgttggcctgccttgctagattggggaagttctcctggataatatcctgcagactgttttccaacttggttccattctctctgtcactttccggtacaccaatcagatgtagatttggtcttttcacatagtcccatatttcttggaggcttcgttcatttctttttactcttttttctctaaacttctcgcttcatttcattcatctgatcttcaatcactgataccctttcttccagttgatggaatcggctactgaggcttgtgcattcgtcacgtagttctcgtactatggttttcagctccatcaggtcatttaaggacttctctacactggttattctagttagccattcgtctaatcttttttcaaggtttttagcttctttgcattgggttcgaatttccttctttagctcagagaagtttgattgtctgaagccttctctcaactcgtcagtcattctccatccagctttgttccattgctggcgaggagctgtgttcctttggagggggagaggtgctctgatttttagaattttcagcttttctgccctattttttccccatctttgtggttttatctacctttggtctttgatgatggtgacatacagatgtggttttggtgtggatgtcctttctgtttgttagttttccttctaacagtcaggaccctcagctgcaggtctgttggagtttgctggaggtccactccagaccctgtttgcctggatatcagcagtggaggctgcagaacggcgaatgttgctgaacagcaaatgttcctgcctgattgttcctctggaagcttcgtctcagaggggtacccagccgtgtgaggtgtcagtctgccctactggggggtgcctcacagttagcctactcggggttcagggacccacctgaggaggcagtctgtccattctcagatctcaaactctgtgctgggagaaccactactctcttcaaagctgtcagacagggacatttaagtctgcagaggtttctgctgccttttgtttggctatgccctgcccccagagttggagtctacagaggcaggcaggcctccttgagctgtggtgggctccacccagttagagcttcccagccactttgtttacctactcaagcctcagcagtggtgggcgcccatcccccagccttgccgccgccttgcagtttgatctcaggctgctgtgctagcaataagcgaggctctgtgggcgtgggaccctccgagctatgcacgggatataatctcctggtgtgccgtttgctaagacagttggaaaagcacagtattagggtggcagtgacccgattttccaggtgccgtctgtcaccccttccctttgctaggaaagggaattccttgaccccttacgcttcctaggtgaggcgatgcctcaccctgctttggctcacactcgatgggctgcacccgctctccggcacccactgtccgacaagccccagtgagatgaacccggtacctaagttggaaatacagaaatcacctgtcttctgcattgctcatgctgggagctgtagactggagctgttcctattaggccatcttggaaccgcctctcccacattttctttatctgttcatctgttgatggacgtttatgttgcttccatatcttggctattgtgaataatgctgcagggaccatggaagtgctgatgtctttcttgacgtaaaatttcatttccttatacactctgagatgggattcttggatcatgtggtagttgatattttcagttttttggggaattttagtaatggctgtattaatttatattcctaccagcagtatacaagggttctgtttttgtcacatcctcatcaacacttactttgttttgtcattttgataatggccattgtggcctggcacagtggttcacgcctgtaatcctagcactttgagaggttgaagcaagaggattgcttgagcccagaagtttgagaccagcttgggcaacatagtgagaccttgtctctgtaaaaaataaaacaaaaattagccatgtgtgttgatatacagccattgtcccagatacttaagagactgaggtgggagaatcgcttgagcctgggaggtcaaggctagaatgattcatgaatgcaccactacactccagcctgggtgacagcaaaaaagccattcaggtgtgaggtgatatcttattgtggtttttatttgcattttcttgatgattagtgatgttgagcatttttcatacagctgttgtccatttatgtgtcttcttttgaggaatgtctattcaagtcctttgcctatttttttaatcaggttgtgtttttagaactttctttcatttagtttccttacgtattttgggtattaaccccttatccgaggtatggtttgtaaacatttttttcctatctataggctgtctctttatattatgggaatttttaaacatatacacaaaagaataataatcagggactctctaagttcctaattcctagcttcaagagaacattttctttttttttttttttaaagagagtataaattagtatttccttagtattagatatctaggaagttctctctattgtctcatgaactttttttttaatagttggtttgttcaaataagggtccactcattacacacataagcttaataagccttctagtctggaagattccaccttcttttttccttttccttttactgcctatccacattctggatgttactaattgtatcaagtgtcatttagtgtcttctcccggcccctgtgtttgctataaactggatttagttctggtggcctgatcagaaccaggtttgaattcttggcaaggatccttccttctgcatcctgtcggaaggcatgtgatgtccagttgtcccttcataatgcgatcgatcaggtgccagaggtgctggggttttgtttattattattattattattattattattattattattatttaactgcacaagtaatatatattgttcctttacccccccaaaaaaacaacaataatagactgccaaatttttggaccttttctgcatttagaggtagttgaaatcacaagggaaagtggtggtctctaggtcagggatcccccacccctgtggcttgttaggaaccgggctgcacagaagaaggtgagccgtggggcgagagcgagcattaccacctgagctccccatcctgtcagatcagcagcagcattagagtctcataggagcaggaacccaattgtgaactgcacgtggaagggatctgtgttgtgcactccttatgaaaatctaactaatgcctgatgatctgaggtggaagagtttcatcctgaaaccatcccctctgaccctctctgtggaaaaattatcttccatgaaatcagtccccggtgccaaaaagattaggggcagctgtactagggccaccccctcccctattcctggtagaaataattgcctctcagaatgctctgggtgaagacaggagcctcctgggctggatggagagtggagagtagcgcagagttaaatcatttggggatccttccacaatcccccatccaatcaccctgcctaccacctcagtccatgctgctcctcccatcagttatctctgagcttactgtactcacagcctgctcctagagcttctgctatgggagagagggttgtccagtccaggccactgtggcttctgcctttcagggattcattataatttccagtctatcagaagcattcttggttgtttcctgatggaatgaaactgttttgaaattgcccattctgtaggtcagaaatggttgaatatcagcagtttcatgtggttcaacctaataaataatggggttagactaaaatggttacatatttctcaccccaagttatgtccttataatgtatttatacctgacattatatatttgtgacctgtttccctctaagccatgtgagatcaaagtcactttctgcccagtttgcaccatatcaccaacacccacaacagttcctggcccatctttgctctgtcagtaatttttgagggcttgaacatagtcatttgaatagagagataggctggagtttgtgttttggagacatcttgatcaaaatctcaatggctgtcaacgtccatgtgtttggaggtaatagtttaagaaaatgattataatatgattgctaaatagagtggaatacaaaactccatattcaggatgatccagatgtataaagtattacagatgatactgtaaagtctgaattgggcactgagccttgggttaatctgttacttaaacagtatgactatacgctgttgcatttcccagatcttttactcacatgtcttaaatgtagatgtttcacatactggctctttcaagaaagcagttgggtcagaagatggagactagaaagaaaacaggtattgccatcagatctggtttcattctatcttagccaggtaaccttaagatcttctactatttttctgtttatgagacatatggataacctgccctcttaatgtttccttggaagttcaaagtctctaataagtgccttttgtgggatcttgcatgtgttaaccttctcagtaactgagtgccattattgagagtgtgtgcatactggctggagggtccactagttgacactactttacaacaacaggaggaaagaatctgttaaaagaaggatccctggcagggtgcagtggctcacgcctgtaatcccaacattttgggaggctgaggcaggcagatcacctgaggtcaggagttcgagaccagcctggtcaacatggtgaaaccccgtctttactaaaaatacaaaaaaaaagtagccaggtgtggtgagcacctgtaatcccagctactcggaaggctgaggcaggagaattgcttgaacccaggaggcagaggttacagtgaaccgagattgctccattgcactccagcctaggcaacaagagtgaaactccatctcaaaaaaaaagaaggatccctaagagaatataatttagcatgaaatctcaatttttacattgattacttatttggggtgataacgttttgaatatattaggttagacaagattttaaagttaattttacctgtttctcttttactttttcagtgaccactagaaattttaaaactatgtaggtggctaacatcatattgctgttggatgcatcttttaagtgctgctgcctttgattgagctgagtgggttccagttaaccaggcttgagcacatatatcattcattatgtgtttgaacatctcatagcagaagatgccttgcatatatatcattcattatgtgtttgaacatctcatagcagaagatgccttgtggttaatgccctctatgtgttttactgatagcacatttcttagtaaagtgaatcttggtgtattgagacgggcatctcctacctccacttgctgatggcatcagatacaaataggctgtgccatttttagcctggggtttcccagagtcatacccacagccccaacttgtttaacaggattgtaacatcctgtaaagccaccccgtggattatagaattccagggcagctggggcaggagcattgaatcaggaggtttcatcttgactctgtttggccctgtgcaaatcactttacccactacacgttggttctttcttcccaatggagggctgaattgcaccatctctctctctcattcttttgttgttttttttttttgtttgtttgtttttttgagacagtcccactctgttgcccaggctagactgcagtaatgcaatctcggctcactgcaagtgtgagccactgtgcctggccaggctccttttccctacactgcccgtgtattctctccagggacttacctagaaccacacacattggcctattgccgtaagtttgtcagcacgttgtctcagaaaaaaaaaaaaatcctcatcctaaagtgttcttcaaaggctagcgagattgtttaataatacggctattcttattttatagatggccaagctaaagcacatcattttcttttccttcagtgccagcatgagcagggcggggggaccaacctcagatttaagaaagacatgtggctgatttttagggttgtttttagaaacattagatttcttctctaataatgaaatatacttttgaaggactctgacaatgctggaagctcttttaagaaaaatgtcattcttatctgaaaatctttttttttcttctctctctcatgctacattacagctgatgaagttaaaaagcctgggcataagaaaaggggagccctgggtgtgactgccctggaaaaagaggtagagagtgcagtgggttcaagtatgtttgggtatgtgcagtcagtctttgtgtctttctcattcaagtaaattccatagcaattaaagtgaaaataatcatctttcatttgtgagtagagcatccatagaaagcaacatatatcttggtctagaacttaaattccaaaagaatgtgttatatttttcattttcccgtttttgttgcacagggacgagtttcctgatgcttccttgccataggccctgggctctgtgtgtagtgttcttcccaaaccaaaaattaaaaataggaaaatcagaatctataccaagaactttgtctaggaggcttgtctgcagtaggtttcttcagtgcctatgcctcctgctggattgtgtttgattaatccatttcttttaacttgtacaaggtccccattgttagagccacaagtcatttggccactgagggtaaaagatggttaggagtgggatttgttccacttctttgcagcgattaaacagtcagtttgaactggggaaagtatttgacctttagtctgtcctaaaagaatgtcatcaggctgtttatacattaaaaggctctcataagatatgtactcccagattcataattttggaacttctctcctatggtacacacccttgtatgtatgcacacctggctctcactgagtcacttatgggaaactgaagcaagtttttctattaataggggaaaaaagacctcataaaagagtcaaagtaaatgagacttagagaaatgtagaagcatgactatgcatcactgggcctttgcttagtttttattcatcagccatggagaagaaaggcatgactctttcctgcctcccacacccaccggacttgtaaagctcgacttcgatgatgcattataaagtggtgcacaggattggtttttaatgagatttttgccattggagcaaagcaagactgtttccctgccagctgctttattcaagtcatgaggcattttgttgtctcctcctgtacttgtggtacatgggccctccattttctagcccagttcttgttagatacctttgcacattcatttgtatgtatggcagaactgatgatatggcctttctttcacccccaactactaactgtccatgccattaaagatacatggacaggggattccagcaatttctacagttgctcttctttctctttaccattaatcctgatgattgtaggaaatcagtacaccatatttattatgcaaatctaagaaaaacaactagatctataaactatttgaaaagatgcccacattgtatttttttgttgtttttttagataggatctttctctgttgcccggggtagagtgcagtggcctgatcgcagctcactgtagcctctacctcctgggcttaagcaatcctcagcccgtctagtagctaggattacaggaatctgccactgtgcttggtaattttttttttttaaggagatggggtctcactatgttgcccaggctggtttcaaactcctggcctcaagcagtcttcctgctttggcctccccaaagtgctgggattataggcatgagccactgcacccagctacatattttttagaaaaggatcagatgagtaggacttgctcaactgctatcactgtcagaaatatctcaaggtgaaacttgcaaacatatcagtaaggagaaggatgagatttcttttttaatagtcttctttatcaggaatgttttgcagatattgattttttttttttttacaatgagaaaaatatgaccaaaaactgaatattaaaggaagcagagtgtgattcccggtgctaaacagtttctataaaatgtggctaataacatattggcctgttgtgcctaaggcctgtgtttgggttatgccttctcaaagaatgcagtggaagaatctcagcttagaagtgaggacatccagaattctttcctggctgtgccgtgaaattcctttgtcacttagtgtcctcatctgctaaatgagggtgttgaattgattcctaaaagttctggtatcctcccctcttcagattatttcttcaacttattttcttggtagaactgggagaggttcgactttgcttttgtcacgcattcttactcatcaggaaagtcccgctataaacacagtgctgagggatcagttatgtcagtctgtttccttctcccagagaccagccctgccttgggcttcccctagaactttatgtcatagcataaaggcccgtgtctgggccctgaggttgggagtatgctctgatgtcaagtatttgatcattctctttctgcctcttgatgactagaaagcgttttatggtaaagagttacgcaagaagcctttgtttagctctttctctcattgctaaaaatagtaagctgtttttaacccttactgttcttacttcttcttactcatttccctcactctttagctgagaatgtcacctccacctttatagagaagacagaaacttaagcataaactcttcaccttccttcaccttccctttccccagttacttgcgtccctgttctttgtcatcctcttgtctgtagctgtccttgaagtggtgtccactattcccctggatgaggttcattcttacgttctgttccataacctagttgtgttattaacttcccatcatacatccttttattaaaaatcctacactaccagtttttgagttcctattaggtgtcacaatcagttaatcccacttacggcatacagcagtcattattccagtttatacttgaagaaacttaggcccttactatgtttctggcactgcttattatcacagctctagaagacatcttctatctaccttatccttcccttttacaaaaggtgagaaaactgaggcccaaagaggttgttgtcaccacctatgtagagtgaggatttttatttttgtgctattgtttagcatgatctcatgaaatataatagaaaataaggggaaactatggtacctgtttattgagcagccttccttgactgggatataaacatccattggttttcctcctttttcatgccaccacaagcactcaggggcactcttgataccagaacagtgggaggatcttagtgatattggtccaaattcataagttttcacttctcttttttttgagacaagatctcactctcgcccaagctggagtacagtggcgccacagctcactgcagcctttacctcccaggctcaggtgatcttgccacctcagccccccaagtagctgggactacaagggtgtgacaccatacccagctaattttttgtatgtttttgtagagacagggtttcactatgttgcctgggctgatcttgaacatctaaactcaagggttccacccaccttggcctcctaaagtgctgggattacatgtgtgagcctcacttccttctggttatagagacagaattgttccacttcttagtctgatgtttctgtcagaattttttctcatgactgcctattcacgctgctgtttgattcttgggatatattttaaatgatgggtagattcacttcccctaaaccgtcctccttatgagcagccgttattctgctctgccagtaaattaattgactcacgattctgcatgttggggcttgttgtggatacagaccgtattctgaaatgtcctcagaggtcgatgattgtgtttgcttctgccaggggatgggtgtttgccctcagcttgtttgcaacaccacatttcctcaaaggaaacgtattaactaacagctatcttcaagccaatgtaagagtcttgattcaagaaacaacctaccagtcagtctatttctaggcttttctccctctctttgaaagtgccagtgttcttcctttcactctcttgaactcatttttcctgccagcacacatcattttgtctcctttacttttccataggctgtttttttttatttgtctactagcttttcttatcacatatccctgcttgacaaccttaagcaatttgttggatacccttgatttgaggcccatcaatatgtcatactttgggattggcagaagaaatgtttagaagcatattttccataaatgatagtgacaagtgccaagcacttgcttcatgttgtctcattcagttttcacggggactttataaggtaagtgggattactcccgtttaaggaaactgatataactgaggtgcagagagacgagagtgactttcccagaggcacacagctagtgagtggtaaagccagtagataagccagtccctgaaatccgtgttttccagtaggatcccaagctatggggagataaaaattagtccccttgcctagctagagggctttaaaggttaaagcaagaggaagaagcagaccttatcttttagttctgtaagtttggagtgtatcgtgggtctcactgaaactagaaaaattgtcagcacggctgcattcctttctggaggcttagggtagaatccctttccctgcctttgccactcaccttggcatatggccctcatccatcttcagagccagcaatggcaatggagtcctcacctctcatcatgctgacattgactcttctgcctccgtcttccacatgtgaggactcatgtgaagacatgccgcacacctagttaatccagaataacctttctattttaaagtcagcttgttagcaaccttaattccatttgctctcttagttcccctttgccatctaaagtaatatattcataggttctaagggttagcatgtggacatcttcggaggggccattatttgaaatctaaaatggagatgttattgcatcgcagtctattgggaggtagccactggaggtttttgcagccttgtttttatatttaagcaagggtgtatatgtgtgtcttagtctgttcaggttgatacaacggaataccatagactgggtagcttctaagcaacagaaatttctcacagtcctggaggctgggaagtccaaaaaaagttgccagcagatttggtgtctggtgagaacctactttctcacagatagcaccttcttattgtgtccttacatggtggtagaagggcgacctagctctctgggatctcttttataaggggtctgatcccaatcatgagagatctgcctaatcacctccaaaaggctccatctcctaataccatcacatcttgtgagtttggatttcagcataggaattttgggaggacacaaaacttcagaccatagcagtagggatgttgctaatacctcacgaagaaagaacttaaagaagctgagtaatttgcccaagaccacacaaaaattcattcgaatccagggacaaaactatatttcctgtgttttctccatgtcactcagaaaattcagcatgagggagaaatatgattcttaatatagaatcatatttctatattgaaatatgatttcaatatagctgttttggctagaacttggaagtgaacaggcaggcttaattgggcaacagtccccactttgtggggtgtgatcggcaggcttattccaggcttcttgctgagttataaaacttctgatttatctgatagagaccttcagaaggaggactggtgctattaaaattatacacatttcattctggaatttcttttgagggcatcatccactcccctcagctgtgattgtaaacctcattgctcttggtcagaatttcattcagcattaacaatgacacatcctgttatgctgtgcaggtgtattgctgtttataggaatttaagtttagatcattaaatgtttcaatactgaatgtattgacagttaagttgatgacgcagaaaactacaaatagctgggcaaactataagaggtgtttctcgtctgcaccttcccttctggtatcttgatagtatagcccaaaaatggttttaagcccttgcttctcccccagggctaccctctttgcttgcaccttacaaggttgagtgttgtgaggccccatctggtgccgactccaattctgtctctagcccagacccacacttgtgagctgctatgagttatctgggcatcttggttgacttaatcttcctaacatccttgtaaataggtggatgaatactatgttttatgattggaaaatgaagaatcaaaaagatatggcaatttggtttaagtccacatagctagtagttagggagctttgttgagaaagaaaaatgcatgagaggaaattaagactgtagttaataattatcaggtgcatattaacgttgcatgaagcttaacttaaatacatgttattcttaaggttaaaaagttcaaaacaaaggcgggggttccaaggcaaatgggtggggatagacaggagatgggcagaggtagatgaaatgcgggtgttatggtgtggaagtcagttggagtatagccactggaggcttttgtggccctgttcatatcatagttataagtgggatgttgctaatgcttgactcatcaaaggctgaaacaaagccagagctgaagttgagtacgtgtcaccgttttattggttaatctttcaaaaagagaaaagcctctgtttatacaggctgaaacagtcatttgacctgttcttcaactccatctggaattgctttggggttaacttagcatttcccctaaagcgcatatgacagtgggttgggaggagctcggatggggtttttgttcctccagagcgctgaggccttatttctgagtgaggtggccttggtgccagctaatgccactgtttagtgtgtgatgaactagaagtaacaggttaattttggccagtagacttgccagctgtgtaaacggaaccagtgaaactatttctcagtgctgcctcccacccctggaagaggacatcatgttatctacctgcccctgttggcttcccttgacccatctctcccatgctgtcccctcctccctgtgttactcatcagttcaaatttagaataattgaatgcacagagaaagtggcttgttctgaaaacttctgacaagaaatttccaggtgacttggtgctagattaattttagcctctcttatggattcaaaactgttttgtcagaagacttgaactaagacactttagaattaattacggctgggaaaaagaacaatctaaatgaggcagcgaacaaagattcctaaatatggagcaagacaagtggctctttatttcagtgggtcactggcatgaaaaaatatagttggggttacaggcaggaattactcttagagacatgggaattaaatgcaaggtaagtaccttgtttggaccctgaaactaacaaagcaactgtttaaaaacaaatttttttaagacattggggaaatttgcatctgctctgagtcaaagcctgggatttgtgtttgtgaaaaagctaatagaggaagcaagttggacacaatttaagaaattgttgaatctgggtgatgtgtatatggtgttaagtatatgattttccacgtctgtgatgatgaaacatttttgtattgacttcttaagtgtcttacctggcctttctgagcccacagttgagttgcacctgcaatccaaagtggttaccccgtcacggctgccagaccacagacactttaattcttgttgtgcggtgtgttgctgccagcccagagccaaaaaagcggaataccaccctgaagcttttgtaaacaattgtctttagcttatccagaggaattgagtctggagtaaagacccaaatattgacctagataaagttgactcaccagccctcggaggatggaaagatggccttaaaataaaacaaacaaaaaccttttttgctttattttgtaggaccactatgagacctcagtccttctatgatggaagtcattcttgtgccagaggagtgtgccatattccaatggctgagccgttttgccccaaaacgagagaggtgtgtagtctttctggaaggtgtaccagaataaatcatgtgggcttggggtggcatctggcatttggttaattggcagagcgagtggccccataccctcactcaagtttgctttgtattatgcaaagttttatgaagagttatttcctgttgctaataatttcctgttcctctgttactctcagtcattttaagctgaaccactcaaagttgcaacctacctttttaataagttttgattttgctatctagataaaatgatttaacatagaatatcacattactcaagagtatgcagtctggagccagattacttaggatcaaatctctgctcttcaacaaagtagctgtgtccaagaggacaaattatttgacatatgtgggtttcagttatcttacttctaaaatgaagataattatagcatgtaccttataagactgtgtgagggatgagagagttaatacttaatgaagtctctgaaccatgcctgtcagttatggaacatccaatggctggtaactgcttttgtgaattaaattactattattgatcttctaaaaatggtcagattggcagctgttgcctttgacctgagtttggccattactgcccagccttctgtctaccattatagccaaatcacagaactatggggacagccccacaagggccagtggtggtataaggggtggaatcacagttttagttcccaagcaacaaaaatggctaccatgactaagaagcctatggcttggtccacatgtgctacttctcttataatcccaggtttgaaagtcaggtgcaactcaaaagatcagaagtatcgttagagattaactgcttcataaaatctcccttatgagttaacttagagaatataaatacctaaacacgttagttattcagataatgttaacacctgcatatagagagtagatgatttcttttagcatttatgttttatcctacataatcacagaaaacccatttccttatagttaacagcaagggcacctaaactgaggacacagggttgggagaaatatttctagtctcaaacaagaatttggaatctaaaaccgagtactgagggaagccatttcggagataccactgcgcattgattttctctgacttctaggaaagtacgtcttttacttggtttttttttttttttaaaaaagtggcaggcgaagtttgtatatgtatgtatagcatgtttctggatagttatccacagaatgtatcagaatgctgctagtcttcctctgaagcacagatctgtccacataatagatttgctatcctgggggaaatgaagtatggataaaattcttgtccacttcaaaatgggggcagcttgggaagaaatagtctaaggagagaatatgcatgctcgtatgaatctgaggtcagttctcaggcaaaatacagtgacttggggaactaggagtagaggtagatggggaaagcacaatggagctgtatagagcacatgtaaatgtgggtctgtggtgataatttccagtaatccaagttagcctcccttgaagccaaattaattcagcttcataaagactgagagaatactgggaaaggcaatttaagaaaatggcaaaataagcattcagaaagaaatttttaaatattatccaaaaacatgaagagtaaatagtgctgccacttggtaattttcacttttaacatccacatgatctttcatgtactgatggaataggactgtcatgatgaattgtcaagtggcaagcaagatactcagtggttgtaccatattctaccatttatgttaaagtatgtatatatacaaagaagtaagtatgtaaatatttatatacaaataaaatatttttggaaagttaacaaaaaaagctggtaacaggaaacagggaagatggcagataagagacagggctggccaccacggtggctcacgcctgtaatcccagcactttggaaggccaaggcaggcggatcatgaggtcaggagatcaagaacattctggctaacatggtgaaaccctgtctctactaaaaatacgaaaagttagccaggcatggtggcaggcacctatagtcccagctacttgggaggctgaggcaggagaatcgcttgaacctgggaggcagagcttgcagtgagccaagattgtgccactgcactccagcctgggtgacagagactccatgtcaaaaaaaaaaaaaagtaaagaaaagacagggctaacgtgcagcttccacaaggacggacagaatagcatatggagacactatgatcttttgttccaagaaccactgtaggaacttaccgggaaaaccaaaagaattcaaagatcctttgaaagaagtggcacaccactgcaaattctgcaaaacaggcaagaaactgagttcccaaagtgtgagtcggggagaacctacctctgaatacacatccccactggggaaatctaaaaatccagatcatggaggaagaatttaaccttacctagaggtgaaacggatttagggggttatgtgaaatatgaaagtagaagtagcaacaggaagtgctttggatgtactcccagtctccagcttgagtccagggaagccagccctgactatatctcacagtggccctcaggtaaggcagccagtggaattggagagtgatggcagggcgaaggaagctcccaaatgaaatcagtagtggtttcagctggtcacaaattttctcaggcagagtccaagggactaatgggagccgcagcagatacaagtgagtacaggagctgctgctgatggagtgggcaggtgggaaggggtgaggtccaaaggccatgcttgctttcccagtggggtagctcacagcctggggcaaggtctgagcagggcactgcaggagtgagactagcctcaccaactgcatagtagctggatgaggcctcttgctgctggctctcccccactaccctggtaaagtttatgatacagcagaggcagtcaagatctcctctggaacataaacccagtggcctgacaaaccacccccatcccccaatttcccacagtgtctgcagcaagccctgcccaagaagagtctgagcccagaaccacctaaccctgccccaacctgatggtatttccctacccaccctggtagccaaacacaaaatatttattgccctgcctattgcctgggaaaccaaaatagttaccttgggcatcttagggcaagcttagagccccctactccttctgcagctggtgctctcttgaaagtgccacctcctggctggaggccagtcaactgaggccattacagcaactcataaaacaataaccctgatcccaggacggaaaagacaacacctaatttcactgcctgcaacatcctggctaaccagagatcctgaatatgtccacatgacaacttcactgctagcataagcagcattcaagagagccagcacattaaacatatctacaaccaatgactcttgcagagtttacttcacttccctgccacatctaccagagcaggtgctagtagccacagcttggagacctgaagatggatcacatcgcagtactcattgcagacatcccccagcaacagcccagagcctggtggcctcaatgggtggctagacccagaagagcaataacagtcactgcagtccagctctcaggaagccccatccctaggggaaaggggagagcaccacatcaagggatcaccccatgagacaagaaaatctgaacagcaggccttgagtttcaacctctccactaaaatagtctaccaaaatgacaaggaaccagaaaagcaattctggtaatatgacaaaatggggttctgtaacacccccaaaagatcacaccagctccctagcaatggatccaaaccaagaggaaatctctgaattgccagataaggaattcagaagattggttattaagctactcaaggaaatagcagagaaaggtaaaaaccagcataaagaaattttaaaaaacaatacaggatatggatgaaaacttctgcagagaaatatcataaagaaaaaataaatcacagcttcaggaaatgaaagacacacttagagaaatacaaaatgtagtggaaagcttcaacaataggctagaacaagtagaagaaagaacttcagagcttgaagacaaggctcttgaattaactgaatcaagacaaagaaaaagaattttaaaatgaaattttaaaagaaatttgggtttatgttaaatggccaaacctaagaataattggtgttcctgcagaagaagagaaatctgaaagtttggaaaacttatttgaggaaaactttgctggccttgctacagatctagacatccaaatacaagaagctcaaagaacacctgggaaatttattgcaaaaagatgatcagctaggcacatatttatcaggctatctaaagtcaagatgaaagaatcttaagaactgtgagacaaaaacatcagataacctataaaggaaaacctatcagattaatagcagacttctcagcagaaatcttacaagccagaagccagaagggattggagtcccatttttaacctcttgaaacaaaattattctcagccaagaattttgtatccagtaaaactaagcttcataattgaaggagagatagtctttttcagacaaacaaatgctgagagaatttgccactattgagccaacactacaagaaatgcttaaaggagttctaaatcttgaaacaaaacctcaaaatacaccaaaatagaacctcattaaagcgtaaatctcacaagacctataaaacaataatacaatggtgaaagaacaacgtctttaggcaaaagctagcatgatgaatagaacagtacctcacatcccaatactgatgtcgaatgtaaatgacctaaatgccccacttaagaaaagatacgcaatggcagaatggataaaaatctaccaactaagtatctgcagtcttcaggagaatcacctagcacacatgaactcacaaaaacttaaggtaaaagggtggaaaaagatattccatgcaaatggaaaccaaaagcaattaggaggagctagttttatatcagaaaagaacagactttaaaacaacaacagttaaagcaaagagggacattatataatgataaaaggagtagtccaacaggaaagtatcacatttctaaatatatatgcacttaacacttgagctcccaaatatatcaaacaattactaataggcctaagaaatgacatagatggtaacacaataatagtggggcacttaagtactccactgacggcactagacaggtcctcaagacagaaagtcaacaaggaaacaatggacttaaactataacctagaacaaatggacttaacaaatatatatacccaacaactgcagaatatacattcttttcatcagcacatggaacattctccaaaatagaacatatgccacaaaacaagtctcaacaaatttgaaaatcaaaattatatcaagtactctctcagatcaaagtggaataaaattggaaattaactccaagaagaatcctcaaaactatacaaatacttggaaatgaaataatctgctcctgaatgatctttaggtcaacagtaaagtcaagatggaaattaaaatattctttgagctgaatgattatagtgacacaacttatcaaaacctctgggatacagaaaaagtggtgctaatgggaaagttcatagcattaaattcctacatcaaaaagtctgaaggaggacaaatcaacaatctaaggtcacacttcaaggaactagaaaaacaagaacaaagcaaacccaaacctagcagaagaaaagaaacagcagagatcagagcagaactaaatgaaattgaaacaaaaaaatacaaaagataaatgaaacaaaaatatttgaaaatttaaaattgatagaccattagtgaaattaaccaagaagagaaaagatccaaataagctcaatgagaaatgaaacaggagatattacaaccaataccacagaatacaaaagactattcaaggctactatgaacacctttatgcacacaaactagaaaatctagaggagatgagtaaattcttggaaatataccaccctccccaattaaatcaggaagaaatggaaaccctaaacagaccaataacaagtaggaagattgaaacagtaattttaaaaaattgccaacaaagaaaacatccaagaccagagggattcacagctgaattctatcagacattcaaagaactggtaccaatcttactgaaactattccaaaagacagagaaagcaggaatccttcctaattcattctgtgaagccagtatccccctaattacaaaatcagaaaagaacataataaaaaaagacaactacagaccaatatccctgatgtacgtagatgcaaaaatcctcaacaaattactagctaaccaaatccaacagcatatgaaaaagataatacaccatggtcaagtgggtttcataccagtgatgaagggatggtttaacataggcaagtcaataaatgtgatacatcacataaacataatttaaaacaaaaatcacatggtcatctcaatagatgcagaaaaagcatttgacacaatcctccatctagttataattaaaaccctcagcaaaattggcatagaagggacgtacctcaaggtaataaaagccatctatgggctgggcacggtggctcacacctgtaatcccagcactttgggaggccaaggcgggcggatcacaaggtcagatcgagaccatcctggctaacacggtgaaaccccatctctactaaaaatacaaaaaaattagccgggcatggtagcgggcgcctgtagtcccagctactcgggaggccgaggcagtgaatggcgtgaacccgggaggtggagcttgcagtgagctgagatcacgccactgcactccagcctgggcaacagagcgagactccgtctcaaaaaaaaaaaaaaagccatctatgacaaacccacagccagtgttatattgaacagggaaaagttgaaagcattccctctgagaactgaaacaagacaagattcccactttcaccacttctgttcaacataatacaggatgtcctagccagagcaatcagacaagagaaagaaataaagggtaaaaaatcagtaaagaggaagtcaaactgttgctgttcaccaatgatatgatcgtatacctagaaaaccctaaagactcatccaaaaagctcctagataaatgaattcagcaaagtttcaagatgcaaaatcaatatactcaaatcaatagcacttttatagaccaacagcaaccaagctgagaatcaaatcaagaactcaacctgctttacaacagttgcaggaaaaaaaaagtaaaatgcctaaccaaggacatgaaagatctctacaaggagaactacagaacactgctgaaagaaattatagataatacaaaaaaatggaaacataccatgctcagggatgggcagaattaatattgttaagaattcttacaaaagcaatctgccaaaaagcaatccacaaattcaatgcagtttccttcagagtaccaccatcattcttcacagaaatataaaagtatcatatttctgccaaaagcaatccacaaattcaatgcagtttccttcagaataccaccatcattgttcacagaaatataaaaaaaaaaatcctaaaatttatgtgagaccaaaaaaagagcccatatagccaaagcaagactaagcaaaaagaacaatctggaggtatcacattacctgacatcaaactatactacaaggctatagttatcaaaacagcatggtactggtataaaagtaggcatgcagaccagtggaacagaatagagtatccagaaataaagccaaatatttacagccaactgatctttgaaaaagcaaaacaaaaacatacactgaggaaaggacaccctatttaacaaatgttgcaggataattggcaagccagatgtagaagaatgaaactggatcttcatctctcatataaaaatcaatgcaagatgcatcaaagacttaaatctaagacctgaaaccataaaaattctagaaaataacatcggaaaaacctatctaggccttggcttaggcaaagagttcatgatcaacaacccaaaagcaaatgcaacaaaaactaagacaaatagatgcagcttaattcatctaaaatgcttcagcacaacaacaaaaaataataatcagtggaataaatgaccacccgcagaaagggagaaaatattcgcaaactatgcattcaatagaggaccaatatccagaatctacagggaactgaaacaaatcagcaagaaaaaaaaaaaaggtcgctaagtacatgaatagacaattttcaaaacacatggccaacacacatgaaaaaatgctcaaaattactaatccaggaaatgcaaattaaaaccacaatgcgataccaccttactcctgcaagaatggccataatttaaacatcaaaaaataatagatattggtgtagatgtggtgtaaagggaacacttttacactgctggtgtgaatgtaaactagtacaatggaaagccatatagagattccttacagaactaaaagtagaactaccatgtgatccagcaatcccactcctatgcgtctacccagaggaaaataagtcattatatgaaaaagacacttgcacatgcatgtttatagcagcacaacttacaattgtaaaaactatggaaccaacctaaatgcccgttgaccaatgagtgaataaagaaaatatggtatatatacagcatgggtgtgatggttaatactgagtgtaaacttgattggattgaaggatacagagtattgatcctgggtgtgtctgtgagggtgttgccaaaggagattaacattgagtcagtgggctgggaaaggcagacccacccttaatgtgggtgggcacagtctaatcagctgccagcatggctagaatataagcaggcagaaaaatgtgaaaagagagactggcctagcctcccagcgtacatctttctcccgtgctggatacttcctgccctcaaacatcagactgcaagttcttcatttttggaactctgactggctctccttgctcctcagcctgcagacggcctattgtgggaccttgtgataatgtgagttaatacttaataaactcccatttatctatctgtcccattagttctgtccctctagagaaccctgactaatacagattttggtaccaggagtggttctagaggaacagaatattaaggatggagttcttttattggtatgaggtttctggagttgactgcttaatatgattagacccaaagatgctaaggactctacttctaataatatggataacaccaatagtccttgacttgaactgtttagagagttatgcaaaataaatatatttgagactcctgattcatcactcgtgagaggcaaggactctacataatacctttgaccatatgtggaatcacccttagtgactctgtacataatacctttgaccatatatggaggaccagggaacataatgaagctggttggttgctcctaagttcagtggacaaagtgatgaaagaaaataatgaactcagggattgtatctcccagctccagcagcagatactgagcctcagatctgctaagattgttctgaatgaaagacttatctcctgtagagaaagagctgaaattgtggaaaaacagacacaagctcttatcatgtgagtggctgacctgcaatgaaaggtacatgcacagcctcgccaggtgtctactgttaaagtgagagcattgattgaaaataaatgggaccctgcaacttggaactgggatgtgtgggaggaccctgatgaagctggggacactgagtttgaaaactctgatgaaccttatttaccagaagaaacagctttcccatccccagaagtggcagcatcccctccctgacctatgctgccatcagccttttcacctttgtctgaggagataaaccctgtgcggcctgaggcaacagtgatggcctcccctgaggcagttgccaggcaagataatgttgattcttctcaggagccacccctaagactcccatttgcttctagacctataactggactgaagttccagcaggcccctagaggtgaggttgagattgtgacccatgaggtggtgtgctacactcaaaaagaaccgcttgagttttctgatttatataaacagaaatctggagaacaggcatgggaatggatactaagggtgtgggataatggtggaaggaaaatggagttggatcaggctgaatttattgatttgggcccactaagtagggattctgcatttaatgttgcagctctgggagttaaaaaaggttctaattatttacttgcttggtttgctgaaatatggattaaaaggtggcccactgtgaacaagctggaaatgcctgatctcccttggtttaatttagaggaggggatccaaaggcttatggaaattcagatggtggagtagattagtcactttagacctatttatccctgctggtccagaaaatatgcccttgaccaatgccttgcaaaacagatatgtgagggcagcactgggatctttgaagagccctgtaattgctcttctctgtatgtcagatctaactgtggtaatgtcagatctaactgtgggaaccgcagtcactcaactacaaaacttaaatacagtgggaataattggattccaaggcagcaggggccatggcggcactcagctgtcaaaggcaaggtgggcatagctaccataatgggcagcagaggcaaagcggcaatcagaacagtctgactcgtgtaaagctctggcactggctaattaatcacagcattcctagaagtaaaattcataggaggcctactgcattcctacttaatttacataagcagaaacttctaggtcaaatggacaaaaaactaatttgaattataaaaacagactcacagcccctcaaccaatttccagacttgagctagtttacagacccagaaccccttgaatgaaggggaggccaggtcccgttgaggaaggaccccactatattaccaacaatttatgctgtgaatctttctcccgtccttccccaaggagacctccgaccttttaccagggtaactgtgcactggggaaagggaaataatcagacatttcagggactactggacactggctctgagctgatgttgattccagggaacccaaactgtcatgtggtcctccagttaaagtaggggcttatgaaagtcaggtaattaatggagttttagctcaggtctgacgtgcagtgggtcttatgggtgcctggactcatcctgtggtcatttccccagtgccagaatgcataactggcatagacatacttagcagctggcagaacccccacactggctccctgactggtaaagtgatggctattacagtgggaaaggccagatggaagccattcgagctgcctctacctagaaaaatagtaaagcaaaaacaataccacatccctggagggattgcagagattagtaccaccattaaagacttgaaagacgcagggatggtgattcctaccacatccccatttatctctcccatttggcccatacagaagacagatgggtcttggggagaatgacagtggattacaataagctgaaccaagtggtgactccaattgcagctgttgtaccagatgtgatttcattgcttgagcaaattaacacatctcctggtacctggtatgcagccattgacttggaaaatgcctttttctctatatctgtccataaggaccaccagaagcaatttgccttcagctggcaaggccagcagtataccttgactgtcctacctcaagggtatatcaactcttcagttttgtgtcataatcttattcagagagaacttgatcgctttttgctcccacaagatatcacaatggtccattacattgatgacagtacgctgattggatccagtgagcaagaagtggcaaacacaccagacttattggtgaggcatttgcatgccagaggatgagaaataaatctgactaaaattcagggaccttctacctcagtaaaatttctagggggtccagtggtgtggggcctgtggagatactccttctaaggtgaaggataagttgctgcatttgtcctctcctgcaaccaagaaagaggcacaatgcctagtgagcctatttggattttggaggcaacacattcttcatttgagtgtgttactctggcccatctattgagtgacccaaaagggtgccaattttgagtgggtccagaacaggagaaggctctgcaacagttccaggctgctgtgcaaactgctgtgccatttgggccatatgacccagcaaatccaatggtccttgaggtgtcagtggcagataaggatgctgtttggagcctttggcaggcccccataggtgaattacagtggagccctctaggattttggagcaaggtcctgccatcttctgcagataactattctcctttcgagagactgtccttggcctgttactggactttggtggaaagtgaacttttgactatgggtcatcaagtcaccatgcgacctgaactgcctatcatgaactgggggctttctgactcatctagccataaagtgggttgtgcacagcagcattcagttatcaaatggaaatggtatatatatgactgggctcaagcaggtcctgaaggcactttgctgtgcccgtgcatggcctccatccttgccacctggacactttgggctcctcctgcctttaagtcaacaggctaagaagggagttacagtgctggctggggtgattgacccagactatcaagatgaaatcagtctactactccacaatggaagtaaagaagagtacacatggaatacaggagatccattagggtgtctcttagtattaccatgccctgtaattaaggtcattgggaaactacaacagcccaatccaggcaggactacaaatgacccagactcttcaggaatgaagatttcagtcactccacaaggaaaaaaccacaacctactgaggtccttgataaaggcaaagggaatacagaatgggtagtagaagaaggtagtcatcgataccagctacaaccatgtgaccagctacagaaatgaggactgtaattgtcatgagtatttcctcctccttttgttaaaaacatgtttgtgcatatatacagttgtactaagaaaatatcttcattgtattttctttctcctttatcatatgacatgagatttattgacttcacatcaacatttaagtattgctaactttatgtagtagtatttgggttggtgtttggtgcatttccagttgcacaaaggatagctgtattatgttacgtgtaattatgaccttattattgtctttatttgaagattatgtatgatctcaggagatgtgtatggattcatgtggacttgtgatggttaacactgagtgttaacttgattggattgaaggatacaaagtattgatcctgggtgtgtctgtgagggtgttgccaaaggagattgacatttgagtcagtgggctgggaaaggctgacctagccttaatctgggtgggtacaatctaatcagctgccagcatggctaggatataagcaggcagaaaattgttaaaagagagactagcctagtcccccagtctacatctttctcccatgctggatgcttcctgccctccaacatcaaactccaagttcttcagttttggaacttggactgtctctccttgctcctcagcctgcagatggcccattgtgggaccttgtgatcatgtgagttaatacttaataaactcccctttattagttatgtccctctagagaactctgactaatacaatggaatactacttagccataaaaaagaacaaaatgatggcatttgcagcaacctggatggagttggagaccattattctcagtgaagtaactcgggaatggaaaactaaatatcgttatgtcctcatttgtaagtgggagctaagctatggggatgcaaaggcataagaatgatataatagggccgggcgcagtggctcatgcctataatcccagcactttgggaggccgaggtgggtggatcacaaggtcaggagttcaagaccagcctggccaagatggtgaaaggggtctctactaaaatacaaagaaaagaattagctggccgtggtggcgggtgcctgtaatcccagctaatcaggaggctgagccagagaactgcttgaacccgtgaggcagaggttgcagtgagccaagatcgcactaatgcattccagcgtgggcgacagagtgagactccatctcaaaaaaaaaaaaaaaaatgatgtaatggactttggggcctctgggggaagtgggagaggagaatcagggataaaagactacacattgggtatagtgtacatttcttgggtgacaggtgcatcagaatcccagaaatcactactaaagaacttatatacatcacaataaaccacttgctccccaaaaactattgaaatgaaaaaaaaaaaaaagcctggtaataatggtttcccttgggaagggacagtggttttccttgtactatttaagttttgtaccatgtacaaatacgtgttccaaaagcagtgttacttctattcattttaggagttaatatgaaagtcctgacattaaatctgtttaggctggtgatctaatattgctagttccttggtgagggttgtggtactttcactaccacatccgtctgtttagtagttcagtgattacacgaggtaagaaaatgaaatcatcttaaactcagacctggaccttgaccctgtatttgatattttttgctgccttaagatagtgttagctgttcttgaaggaatgcaaaatgctggttcaggtggctgacatatattcatagcctccatttcttcctcctcctcataagcatggtacctatctcccaaagtgccagagtgacagtgaggacttgtcaagagccattcatctctagaagcactgtgaactttagccaagcatatggttcagttattcaggatctttaaagacattattgaaccagcgggagtgggcttgttatgtcttaactttaggggggaaaagggggtggggtagagatttaggcttttgcatttataacatatactttttagggaaaagtgttaattaagcataattttattttcagcatttataagataaacatgatgtagcatcaactgttcattgtccatagcttgctaaattttgagttgccaagactcttgtgaaaattctgtttcccattgcagtggcatagtgtaagttattttttaaggaaataggttaatttgtttatgtgatgaacacatgtgcaggtgagactttgcccagattggagactttgactttgagtcactccactttatttatatagtatcccaggaaggttagccaaatatgtgtagaagctgccagtattaatgattgttagaagaccagcttagtgcatacagtgtttacagcgcacctggcatgcttctatgcttgtatataccttagttcatttaatcttcctcatacaattgaattatgcgatatcattattctcaatttacacttgagaaaactaaggcatacagagatgatttttcaacagtgcttcagtaagttaacagttaagttgaaaagacttttttttaattaaaagggaatattgaataagctaagaaaaaatgaaggtaattaataacttgaagattagatgtgcagtattaaataaaacactggagaaaaggatcgaacttttcaatgatgtttctaaaaatccatgcctagccttgccactaaaggaattccaagatgtttatccctgtgaacagaaaaacaatcagcacaactctgtggaaaggcaataggcaaaagagaaatcactttctaaccagcaaaagcttttacagaagtcttcagattctgtatttttaaaagtaatgagaattaacttttcagaagcctggaaatagaactcaacacacctgtttgagaagataagcgacgagaggcaccttagcttagcctgcgaggttaaaagttaagactccagtctgtattctcaaaccagcttagtctcttaaagttgttaagaagcaaatgagattaaagcatataaacaaatgcctggcgagtagaaagagctcagtgcttgcttgtgtagctattagtttctacatgcaaagggctggggaaacaggattatgtgaatgagaaagggtccaggaaacacccttctgtggtcctctaggttttttctgagagcctggcagatagtaggcatttattatagtgacaaatcatctttaagaaatcaacttggtaaacattggggggaagtgcagccttaagttgtgcatgtgctagtatgttttgaagtttctggtttttcttttctaggttcttatagagactgctaagaagctaggactccggtgccactcaaaggggacaatggtcacaatcgagggacctcgttttagctcccgggcagaaagcttcatgttccgcacctggggggcggatgttatcaacatgaccacagttccagaggtggttcttgctaaggaggctggaatttgttacgcaagtatcgccatggcgacagattatgactgctggaaggagcacgaggaagcagtaggtggaattcttttctaagcacatatagcatgggtttctgggtgccaatagggtgtcttaactgtttgtttctattacgttagtttcagaaagtgcctttctacaaggttttgaagttgttaatattttctgtagttccattggaaggtaagaacaaagatcaaaggaaagaaagagacacttttacccaaggatcagtagtgaaaatagtacattgtaggcaggtagatgtgttgagaatcatactaagacttgggccttattttcaggataaaggtgtattttgattgccaatttctgctgctatgctactgttttttgttttcaagaaggaaaaaaatctattaaccctttcctcatgagagggctgtatgttcacatccatctatttaacgtaccgtggctggatactctgttcagcatagaaatgtgacaacaaacagagaagtccttaaggagccgacattctgtcggatggagatagaagttaagcaaaccaatataagaaagctaacggttataaagaaatagaatggtgaggtacaagggtacactaggtcaactgaatagagttgaccagaccaaatatttgaagtatgagaagccttcctgttttaagtgtgatgggcaagaagggcatgattgagtagagtggaaaggagggagactggggagaagggagagagaggagggatgcaatacagtagggccaggccatacagaccatggtaagggtttcagatggaaggacagtgaggggttcaggcagggaaggcagcaggatccagctggaatttgaggacactggaacaatgaggtcagcttccaaaacaaaacaaaacaaaactttaaacatctgtgtaagtacagggtggaatataatgaattccaggtacccatcacttaggttccacaattagccatggccaatcttgtgtgataggtatgtccctacctatttctcccctgccctcattgtgaagtaaatattttcctaaaaggtctttttaaaattaagttataaccatgccatcattgtacaaaaataatgatattaatttcttaatataatcaaatattcagactattcctttttccttcagtctcataatttttaacaatttgatcaaatcagaatcccttacaatccatatgttgtattttaatgattacctcttgtctcttttaatctaattttcacctctttctctttttattccttgtgttacttgaataaactagatcgttcgtcctgtcatttatctcattttaagataaagggacgacaaaactgcagtcacttttgaagtaaggaaaacatttaggggtgactttctgagcacatttagggtaagtgacatctccaaagaggcctaatattgtaccaccgttttagagagtttgttttactatctaatgtgtacagtgttttgggtcatagatgaacacaggttctttgtttttcatgaattccttatgatgactcttcagtgtaataaactgtttgcttagtactaggatgccttttatgtaagagattcgcaaattattacattaagtcacaacataatatcttatttggcagctttggtaacctaaggaacaactcagcctcgtaatgtcaagaagctgcttccaattaataggaaactccagcccctgccacaccctgagagcggtttgcttcctgcctgtggctttctgctcagtctaataacatatgtctcctcctttgtagaaccagcagtgatttcctttagtagccaaatgaggttggggaaatagtcagctggagctactttattgaaaagcagagaaattaagctctgtaagtggaaaggcttgaagacagtgttaaatgctacaaggaaggcccacagaaagatggcattatttcagccaatcgtgtgttgcagcctggcatggcaaaaaggatttggagttctctaaacccatcttcagatttgagttgctccatttgcttgtcacattgggcgagttatttcacttgtttactcttctgtagaatgaagccagggctctgggtgaggagtggaggttgtttagtcattgtttagtcagttagaccttgaaagattactggaagaattaaaccaaatgagatatgtaaaaaagctagtataatgctggcttgtaagagggtggtcatcagatggtggctctgatggagtggggggcctgagaggtgggtagtatcagggaaaagcatttaaactgcaccttgaagagagggtttattttgggaaggtcagtaggaaggacattttgggtgaagcccaacagctggaacaaagagaagggaggtcagtgtctatacagaaataaccagtcacaggaaaaatatataaggaaatgagtaaatacaaggcaaatttcttggatgcttcatgtctgcattcaaagactcagcttaaaacatatcatttacatgtgcctggcagatacccagcctgtcactgctttgtgttcccatagtagtgcaaactcccctctgctacagtgttcatcattttttcctatacacatcttggtgtttgtgggtgggatctggactatgcttaaggaaatagaaagatgtaatccttgtgtccctgaatgctggatttcttcgaagcataggaaggcatgtcaagtactctatctctgatggtaattttgtgttcactttcttcaactttttcttatgaagctattttagtcatatacagaagtagctaatagcacgagcttccatgaattcagcatctagcttcaaccattatattaacttacaaccaatatgattattactcccatcaataattttatccataaacacttcaggaggtatctaacatgagcacattatcattttcattctccaataataattctttaatatacccagccagaatttaaatttctggttaaatgccttaaattattcttttggttgcaagctttttatgaaggaaccagatcatttgtcctgttgagtttcccacagtctgaattgctgaaatcatctccttggagtagtttaataggcttctctgtcctctgtattgtctataaattggtagctagatttagaaatttaatcagattcaggtgtcttaaggtagcattttattttttcatcaggaagcacataatgagtggtttatttgggattttgtttggttcggtttgtgatgttagcagccaatccattaattcactgggagccataaaaatggtggtattttaattccataatatttttctttagtagctggaataattttctaaggagaaacgtacctgtttggttttccagtgtagcaacagttttaacattgtaatcccttcggctgtggacatgaagagaacagccacatctttctagaccatattaacccattatacatctgagatattttctccgataccatattgaaatctgtattagtctgttatcacattgctatggagaaatacctaaaactgggtaatttataaagaaaagaggtttaattggcttatggttctacaggctgtacgggacgtgatgctggcatctgctcagcttctggggaggcctcaggaaacttccaatcatgttggaaggcaaaaggagcgaggcatctcacatggtgggagcaggagcaagagagagtgagaggagaggtgctgtacacttttaaacaatcagatctcacaagaactcactatcagtaaaacagcacctgaggatgctgctaaaccattcgtgagaaatccaaccccatgatccaaccgcctcccaccaggccccacctcccacaattcgacatgagatttggtgaggacacaaatccaaaccataccagaattcatcagtgcttttcagagatgtcactgagtttctctaggacctccgtgctaggactaagaccatcttgataaatgccgagcttgaactcaggggtttaaacgtagaataaacagacttcacaagtcaggtttttcttagtctgtctggactgttgtaacaaaataccatagcatgggtggcttctgaataacaagtttatttttcacatttctgtaagttgagaagtccaagatcaagggactggcacatttggtgtctagtgagagcccactttctggtagacagccatcttctcactggaacctcacacggtggaaggggccctcgaagaatagcactggggcctcttttgtaagatcactaatcctatccacgaggactctgccttcatgacctaattgcctcccaaatgcccaacctccaaataccctacattgaggattcggtttcagcagataaatttgaggggacacaaacatttaggctgtagcaaggctggagctcagaaaaatgttttatgacaagcagtggaattttaagttctagtaacctccagtgctattgtttctctaggtttcggtggaccgggtcttaaagaccctgaaagaaaacgctaataaagccaaaagcttactgctcactaccatacctcagatagggtccacagaatggtcagaaaccctccataacctgaaggtaagtgtcagccatggacaatcaggcatgtctgtagactctctattgtcttcttttcttacttgcatttcacctttggtcctcatgtattttatgccagcctagatgttttcaacaagtttttgtgacatctactactaccataccaaccacttgtgaaactgagtagtcttattttctggctggtagtgcaagaccactgaaggctagggttgagagagttttattatctcgtgtaccagattcttcacattgccctgctctgtagtatccctaagtcttacttcagaagattgatagtgctttctctgcatatcgcttacattgttgacaaagctattttctctttggcagatccattcaaatttgtggcaatcctttaaagccaaaactctgacaatagtaccaaaatggtgccagaaaatatctgcttaaggttaatcatgcatcaaactaaacagtaattaatgataaaccaactctagtattctcagaatataatttaaactaactgataaactcggagttgcatgatttttctttgggcactttgtgactcttcttaaccacatagggaaagacttgtctcaaactgatcagatattgcattctcctactatccaaagaggaccataccccaaagtctcctagaatacacctgtacttttgggtcttctggtggtggtggagagaggatttgaaaggttgatctaagccctccttacctgaattaccacctaggagctctgtaatgagagagccacagttttagtataatgaggacattgtatggtggtaagtgactgccaatcactgggcatggcagagccttgatttgtaatgtttgctaatttacgtggtacaagtgctccagtacggccagtttcacactactaatgtgaagccactgatgagttgagaagtgatacacacagctcttgcaagctggtacgaacagaatccagcacaccactgtaactaaggtgtctctcagcagttaggactgacggtcaagaatgttggaatttgtagcttatcttccctactaagaaacaaatctattggtttcaacactgtatacctaggacctaaatgttatttaatgaataaatgatactcctttcccccatgaagtgttttatcataatatatagagatgcaggaaacccttattattagaattaaaagggaaaaaatacatttgagtgcagtcaaatggcacaactggagcttgcataaaaaaacgcatgttggtttgccagaaatgtgactcctacttgtactattgttagcaaaatgtcatagaagtttgtttgtttatttgtttgtttgtttgagacggagtctcattctgtcacccaggctggagtgcagtggcacgatctcagctcactgcaacctctgcctccctggttcaagcgattctcctgcctcagtctcctgagtagctgggattacaggcatggaccaccatgcccagctagtttttatatttttagtagagactaaacctagtagatgaccaacatggtttcatcatgtcggtcaggctggtcttgaactcctgacctcgtgatccacccgctttggcctcccaaagtgctgggattacaggcatgagccactgcgcccagccaagtttattttttttaagtctcccaactaaccccactttgaccatagtctttcaaaagcttgaagttaatttctcaaataatatatttactgttttagctttatttttaagtaaaaatgcttgaagagtagaaatcagtgttctcctttcctggagcttctgaaattgtaaaattgtgtgattttatttgtatgcatttttaaagaggcttagtttacgtagctttcatcggattttcaaaggaggattttatatatatgtgtatatatatacacacatacatacatatacacacacacacatataaaacctaaagagagaaaatgaggaattcctgctctagacaaaactgagaatcttggtcttcatgctacagcattaaggaacaccatactaataatccctttttctggggtagtattgttagcactgaaatgtgtatcattcattccctcactaagtcatttcagaaacacttagcacctgctatacgtcaaggtctggtttgcaaagataaagagttgtgatgatgatcctatggtgtttggagatatagacacataaaaatttcaatgatttcttacagtggggtaaggataagggatagaggttgcataaacaataatccaggctgggggctggtatggcaataagtgattatcagaacaatgctctgagataagcattattaacctcactttacaggaaagggaggtgaggaaccaagagtttagagtacccgaagttccacatctggttagtgaacttgaaaattttctgtagaatttatttaaagtgtatgtttcctgcgtcctcactttgatctagaaaatcaaaatctgtttttttttttaacaaacatctcagtaattacgccaacatgtgaatatcactgcctcctttcttcctttcagaatatggcccagttttctgttttattaccaagacattaaagtagcatggctgcccaggagaaaagaagacattctaattccagtcattttgggaattcctgcttaacttgaaaaaaatatgggaaagacatgcagctttcatgcccttgcctatcaaagagtatgttgtaagaaagacaagacattgtgtgtattagagactcctgaatgatttagacaacttcaaaatacagaagaaaagcaaatgactagtaaacatgtgggaaaaaatattacattttaagggggaaaaaaaaacccaccattctcttctccccctattaaatttgcaacaataaagggtggagggtaatctctactttcctatactgccaaagaatgtgaggaagaaatgggactctttggttatttattgatgcgactgtaaattggtacagtatttctggagggcaatttggtaaaatgcatcaaaagacttaaaaatacggacgtactttgtgctgggaactctacatctagcaatttctctttaaaaccatatcagagatgcatacaaagaattatatataaagaagggtgtttaataatgatagttataataataaataattgaaacaatctgaatcccttgcaattggaggtaaattatgtcttagttataattagattgtgaatcagccaactgaaaatcctttttgcatatttcaatgtcctaaaaagacacggttgctctatatatgaagtgaaaaaaggatatggtagcattttatagtactagttttgctttaaaatgctatgtaaatatacaaaaaaactagaaagaaatatatataaccttgttattgtatttgggggagggatactgggataatttttattttctttgaatctttctgtgtcttcacatttttctacagtgaatttaatcaaatagtaaagttgttgtaaaaataaaagtggatttagaaagatccagttcttgaaaacactgtttctggtaatgaagcagaatttaagttggtaatattaaggtgaatgtcatttaagggagttacatctttattctgctaaagaagaggatcattgatttctgtacagtcagaacagtacttgggtttgcaacagctttctgagaaaagctaggtgtttaatagtttaactgaaagtttaactatttaaaagactaaatgcacattttatggtatctgatattttaaaaagtaatgtttgattctcctttttatgagttaaattattttatacgagttggtaatttttgctttttaataaagtggaagcttgcttttttaactctttttttattgttattttatagaaatgctttttgttggccgggcacagttgctcatccatgtaatcccagcactgtgggaggccgagacgggtggatcacaaggtcaggagatcgagaccatcctggctaatgcgttgaaactccgtctctactaaaaatacaaaaaattagctgggcgtggtggtgggcacctgtagtcccagctactcaggaggctgaggcaggagaatggtgtgaacctgggaggtggagcttgcagtgagcagagcttgcagtgagacgagcttgtgccactgcactccagcctgggcaacagagtaagactcagtctcaaaaaaaaaaaaaagagtgaaatgctttttgtttgcttcagttttttatcatggggagatctttttcctcagaattgttttcttttcactgtaggctattacaggatacttcaggatcaagatacagaaccttttatttaaagagtttgtaaagtcaatgtgtttgtttgtgtctctgagattgacttcaagataataagctgctaattgtaaacaaaacagttaccctccagtattaatatgactcattagtgtgagccatttgggtcaagtatgattatgacccttggacttcctgatgtagtattaaatttcaactctggttatccattagcaatctgtagagaacttaatgaacctgaacccaggcttctctagctctggtaacgtgtgattgttttcactacaatatgatacatagatggtaccttacttttcctcattcttaataggtgtctaagaatgtcagggcaaaagtatgggcatttttcttgctatgttcagaaagtacagttctctccaacttgcagaggtacttttcttgattaaatagccttctctagcaacatcattttcagactaactaaatgaatgcagtatactcttttctttgttctcaatcattcactccttatgcaaagccaatataattttcctcataccttatgcttgaggatattgttgaagaacacttcctggaacacttctcacttgtgatgctgtactaattttttttttttaatttaagctagtatactaagtgaacaccatggtcagttgtgagcattttggtttccgcaaaggatggatggtgagcatcatgggaaagctgtagtttagtgacttagcccttagtgattaatagatttgcatgtacatagaagtctttgttggccttataatctgctgttatatttggcatggattttcatggttttgagaatgacatcctggccctgtggtccccgagggtcatggtccttgtgacctggcccctgttcactgcccccttcgctagcacgagttgctgtgcagggctggaggtagctaccatggcttgtttcaaggaaggaaactctggtacggtggcaccctcaggagtggaggacagtgaacttccttgaagagggagtgactaaggtgacctccaacctgccctgagccagctgccctgcaggtgccacgtgagcctgctctggcatccacaggatgctcctggagcctcttctctggctgctacctcagggcatggttgtggccccaccaacacctattttccaaataattattcattcttgtgacagtggcctgaacatgtttttaattttctcaacaagcatttagccagcacttatccagtgaaacaatttgataaggtttcaaggagtatctgatgggttaggaagtcacgaaatgaggagttcttgccacatttgcagagtccctccttgataaggtttggcggtgtccccacccaaatctcatgttgaattgtagttcccataatccccacatgttgtgggagggacccagtgggaggtaattaaatcatgggggtggttacccccacactgctgttctcatgatactgagttctcacaagtcctgtttgttttataaggggcttttcccccttttgctcaacacttcttcctgccatcatgtgaagaaggacgtgtttgtttccccttctgccacgattgtaagtttcctgaggccttcccagctatgtggaactgtgagttaattaaacctctttcctttataaattacccagtcatgggcagtcctttacagcagcatgagaatggactaatacactcctcaaatgttttgaagattgttgcaccttggaactaccagtgtgcacacaatctggctcaatgtatatattggcccagcaaggcaaagaactgaagttccaggatggaagaacctgtgttctcctcataatagtatagaataattcaagataggcaagaaggacagcagtaaatgaagaccatggaagaaaagaaggaatgccaaagatcgaggaaatctaccaagactagtagggtagtccagaagaagctgtttcagggcctgttgccagctatgcctttgagaacctcgggatcccaaagaatgaggggaatttcttcagaaagacaatctcggcatgcattatttctttgttttgaagattcactcatgttgcatgcatctgtagcttgtgccttttttattgcctagtagtattctgtcatatgcctatcttacaatttgattatctattcacctgttgatgaatgtttgaattttttccatttgaggaattttatgaataaagctgctataagcatgaaattacaagtctttttgtgaacatattttcacttgtgcaaatgcctatactcccaccagtaatttgtaagaattcttgacaaagcttggtattgtcagcgtttttaattttagccattctattgggtatattttgatatctcgtggttttgatttgcatttttctgattaaagatgttgaacttcttttcatgtgcttattggccattcacatatttcgtgaactatctgtacaaatatttttgtttattaaaaaattagattgttttgttttattattgaatagtaagaattgtttatatattctggatacactctttttcagatatgtgtgttgtgactattcttagtctttagcttgccttttcattttcttaattatgtctttcaaagaacaagtttttcattttgacgaagcctagtttatcaattttttttatggttggtgctttttgtgtgttccaagaaatctttgcctactcatttaattacctgtgtgcccttgtcaaaatcatttaattttgactactcacttaattaccttgcctactcatttaattacctgtgtgcccttgtcaaaatttactgtttatctgtgaatctggatgatctatttatgtcatttatctatgtgtctcttcttatgccagtaccccactgtcttgattattgtggctttatggtgtcttgaaattaagtattgttaagctttgcaatcttttccaagattgttttggctataggtcctttctttataaagtttatattaagcttctccatttttctttaagaaaaaatctgctggaatggcactgaatttttaggtcgatttgggaagaattgacaatattgaacctttcaatcgatggacatggtatgtttctgcatttatttgggccttttaaaatttatctcagcaatattttgtagttttagtgaagaagtcttgtatatatcttttgttaaatgtattcctaaatattttgtggaaatgttactgtaaatagtactttaatttcatttttaagtttattgctggtatacagaaatatgttttatttttgtatattgactttatattctgtaatcttattaaattcacttagttcagtagtagttcttatttttattttattgcaagtgccttagggataccttgtgtacacaatcatgtcatatatgaataacaacagtttaccttttgtttcttcttgctttgtcgtaatggctaggaccttcaacctaatgttgaatagaagcggtgtgtgagttgttactcttgtcttattctcaacagcagaggatagcgtctagtttttcactattaaaatatgttagctataggttttttccgtttcatgtttttatcagattgaagatcccttttattcctattttgccaagagtgtcatgaatgcatgttgaatttcaccaagtactttttcctgcatctgttgagagaatcttgacttttctcttttattttgttaatgtagattctttaatgttaaactgatcttgcattcctgatataaaccatacttagtcatgatatgttatcccctttatataatgctggattcggtttgcaaatattttgtttgatttttgcatctatgctcatgagacagattggtctgtgattttcctttcttgtaagtcttgtcaggtgtcagggcttggttaattttgacacatttacaaacatatatttttaagataaaaataaacttcaaaaaaaaaaagatgacgacagcctgagttgtttatatacagaatttgttaaccaaaaagattgaaaaaggctggaacagcaggttacatttgatacctgaaaatattttgcagctataaatgcatcttggaactgttataggcaaaagcttgggaatggctaaaattctcagtgtcataggatgttttaaataaactaaggtacatcaattcaaataagtaatgtgcagttgtcaaaaagaatagatatctgtttatgcaccagtatggaacaatgttcatgacaaaaggggaaatcaaaaatacatagagtaaaataagtttgtggtgatgtatagataggatgtttatacttcatatttccagaaaggttctggaaagaaacttattgatggcttctgagggatgaatcaagagacttaaactgtctacttcatacctttctatagtggttgaatttttcaccacaggcaactgttcctttaattgatatattttaaggaatggatactagaggagacctagcttcatagcagtttatgtaacatgagataaaatatatgattcttggcattaacttctgataggttgtgcttggggcactatatccagttctgggcacaatgctttcaggaggatgactatctaaaaagcaccaagagaagagtgaagggactgaaaaaaccatgccacatatgtaatacttaaatgggttaagtatatctaactacttaggagaaagccttcaatgagaactttgtttaggggctgtcattctcttacagacatgtgcctccctcactgttctgtaagcttttgtaaaggcaggagttgtttttttaactcatcagtttaggagcctcttttccttgtatttagcacaaactcaacaaatatttgtgtaaataaaaatctgattacgtttctttcctacttaaaacccttcatcagctctcccaaacacctccccatgttcactttcagcaggtgactttagttccctcttcacagacagaactgaagcatcagcagaacactttcaagacccccctctgctgctctctcccaaactgttttccctcctgttaccatctgtgatagtgcttctcaaacgggagcacgcatcgtcatcacctggagggcttattaaaacaggttgcatggcaccaccccagagtttccgattcaggatatctggagcatggcctgataatttgcatttccaacaagttcccagatgatgctggtcccactttgagaactactgtcatagatgtttctccctgatcattgtcttatgcaccagaccccatacctcacacctagtaaggacatcagtctagtaactacccatttcataatcatttttctccttattattgaatcactttttcagcacacaaatatactttatttctcccattaaaattcttgaccccaattctatgtgctggctcatttttaagcttttcattggcataaaatccctcgagttattgtttctcctgcctccaattcctcttctccagtctttccttagtcctcttcatttcagattttgccagtgcaccatcttcagcaccaacaagattctcaaggtcaccgatttactgcatgtcaattttcacacttaacccttagtttcctatcagccgcatttgatacacttgaccccttcctcctctttgataagttttctttacttggcttccaaggacaccacactcttgattttcttccttcattgatggttgctgcttcttagtctcctttgctgatttcttgccttctccctgatcttttaatgttgcctgccctagagctcaatccttggatttctccatcttcacttgttccttggtggtcactcctcaacttcccctacacctgctttcccatcccagtctagcagttccatccttctagttcctcagactaaaaacttgaagtccttgactcttctcttcaaaacccacattaaaaccaggaaaaatttatttaccatccaaatatgtcaagatactgactattcctcattacagctactgcttccaacctagtctgagccactctcatctcacctggatactgtaataacccctaacaggtcctgtgtctacttttgttccctagagcaagcaacccaggaggcagaatgatctgtacaaaatgctatttcacttgtattaaaatcccacatttatgatagcctatgaatccccatgtgatttgcacttgccctcctatctctctgacttcctctcactactgtcctcttgctcactctgctccagcccttttccaagaacacaccaggccccctcctgcctttaacattagagtatttggtttgtgttccttctacctggaacactctcccagcagataaccacctggcctcactacagcagctccttcagatctttgctccaaaatcaccttagtgggtcaaccccaaacatcgtattttaacagatgataatgcccttcactccatgcccaaagtactcctaaggactcttacaagcacagcttttttgtttttcccatagctcttaacttctccctacttactctagtatttgtatatatttgtttattgttttgtaactcccaacacacacacttcctccaaaatgtacaacctctgtgacagcaggaaacttgtcatttactgatatcctaaatgaccagactagtgcttgggatttagtaggcttccagccaatactatcttgaatgtacagcttcccaatacatatggcttgcaaagccgtgtatgttctgacttactccagcctctttctcacctcccacacctcatggcactctaaatcagtgctgtctgatagaaatatgtgagccaatatgtaattttaaattttctaggagccacatttacaaagtaaaaaacagttgaaattatttataatatattttaatataatatatccaaaatgttatggagatgtaacatttaaaaattatgaaatttttattcttcaaatactaaatctttgggatcagatattttatactaacagtacatctcaattcagaggttaaatttttttttcttttttttttttttttgagatggattctctgtctcccaggctggagtgcagtggcatgatctcggctcactgcaacctctacctcccaggttcaagcaattctgcctcagcctcccaagtagctgggattacaggtgcctgccaccatgcccagctaatttttatattttcagtagagacagggtttcaccatgttggccaggctggtctcaaactcctgacctgaagtgatccaccagcctcggccttacaaagtgctaggatcacagccatcagccaccatgcctggctgtgaggctaaatttttataagaaatgttctatctgtgtttaaattttgtaaaatttactttgaaaaaatagactcacatacctaagttgttccagtgattttgaagcggctgtcaacttttaaatttaacttaattaaaactaaataaaattaatttcatttgctcagttgcactagctacattttaagtgttcagcagccacacttggctagtgatgtattagcacaactctttgaccccagctccaagcagaccaggctcctccttgtctctggccttttgtaagttgtccctccacttggaagactcttctttgctccaccatcatctctttttatctgactcactgtctgaattagccctttctctgcactttgcaaacaccctattctgttacattactagtcacactgtattataattgtctgattcattgtgtgatggttcaggaattatttctaccttgtttacttctgtgtccccagactcttcggacattacctttcatataagagatactgtgtatgtctatatatacatatatgtatttgttaaataaatttataaatctatgaaatttatgcctatagaagttttagccatccttcggtttccacctcaaatcccttcttcccaggattcttgtcagagcagtccacagcaaatatttcctgttttgtactcccaaaccacctgcagctcatattactcataggccatttgtaatacatgattttactacgtaaaattctacctccccagatagtgaaaactggaagagcaggaattctggaaaagaaaatgacttacatattaggtgttcaataaaaacttgatgacttattaaatatattgtctgatttcagtcttatgtctggtgattacttttcctgaggtaattcagtaaaaccagtgaaaatttttgtgtgttttaaccattatgctaaaaggtatctgctctctgccaggcgtggtggctcacacctgtaatcccagcactttgggaggctgaggctagatcacttgaggtcaggagttgaacaccagcctggccaacatggcaaaacctcatctctactaaaaatacaaaaattaaacaggcatgatggtaggcacctgtaatcccagctactcaggaggctgagcttagcaggaaaatagcttgaacccagaaggcgggaggttgcagtgagccaagattgcgccactgcactccagcctgggcaatagagaaaaactccatctcaaaacaaacaaccaccaaaaactgtctgctctcaatcttttgattgaatagtaaaaccaatattttttttaaaggaaggctacttcccgaatgaccttatctacctatgtgtctgtgtagttggccattaatcaaatgtcatttatatcccaaacttcattttcattcattgttgattcggttgatactcatgtccatctgtctacagatatacactgtcactcatcagtgttatatacaaaccttactcattttattatcactaatgggctcaatcctaaataagatcaaagcttatttttcccttttgcatagtatcttccaatagtcaagctaaagaagaaaaaagcaaattgcattatgaaaatgctatactacacagtctgttctgtgaggtgtagagcaagcattaatgaccctttttttctgtgccagattggaggagaaaagagagaagtagaaacaattaactgtagacagatcagacctttcaactttttcatgctttatgactgcagtcctaatgataaagaaccccagaggcaatgtgagcactccctcgggagggaatgtgagtctggtatctggtcctctctaacagttcatgcctggtaaggatcatggtgtcctggcatgacagacaccaaaagtccacattttccaagggaatgaatgtttacaaatacattggttccttgatgttactagagccctcttcctattctctcctcttttcctaattcatgcccccttattaccttaacagaggtgggagttaatcaggatgtaataaaattgaaaaagtacctaggatggaagggatttggaattctgaatattgtgttttaagttggaaaaaaaagttacataaaatgtattctattgtcttggcagttatttactttgttttttatcttatagtttgtcttcttgagactgtaggcgtctataaactgtgaactaatttagatgccactcctgagggcctggcacatgatttgcacttaatgaacagctgctttggtctgaatttctgtgtcctcctaaaatccatatattgaaatctaatctccaatgcagtagtatcaagaggtagagcctttgggggtgattaggtcatgatagtgtttccttcatgaatgagattagtttctctataaataaggcccgagggagctcttttgccccttctgccatgtgagaacacgtctagaaggtggcatctatgaagtagagtgggccctcatcagacactgaatctgttggtgccttgatcttggacttccacccccgccccccaccccaagaactgtgagaaacaactttattgtttttaagttactcagtctaagatactttgttatagccacccaaaaggactaagacagcagccactaaaaagtgttcattttacctcaatcagcaatttaaaaggaacagctatagaagttgaacaacagtcgtactaaatggttcctaaggaagttatttttgaaaaagtataaatatcaacatgaaaaggtttcagaattcagtgtataagtgaaaaaaggacatgttcttggtttaataatcattttgttgcagagcacttttttcggaataaaaaaaatttgattatttcatttagggaagattaacaggaaatagtgttatcaaactgtgccctcagttttatagatgactcagtcttaaaaactccacacatcggaatgtgatgatgtgttcattagctgctctgtttgacctcactttagtttacgaattcccaccctttaggaatcaagattacaaggctaaagcagtaagtaataggaaagtcaacttcaaatatatacagaaatacaaagatcaatataatgaacccctgtctgccacccggcttcaagaattacttcatagacaatctgtttattctataatcccactgactgttcacctccgacgttattttgaagcatttctcatgtatgatttcatctatgaatatttccatgataagaataaaaatttcttaatgtcagaaaatatttagtgactattcaaaatttcaaatgtgttataaatgccatgttttacatgttgtttatttaaatcaggatccaagtaaagtctatacattgcaattggttaatacatattttgtgtttcttttattttaggccatctcttttagtaaatgtccttgaatgtttcttaagttgctgtatgttcatggaccatttccagagactttgattggttgttttaaaataattttcacccattctgtaggttgcctgttaatgctgatggtagtttcttccgctgtgcagaaaagaactctggactcagttcccagaaaaactagtgaaaattatttttttaatcatttttctttttttttttttttaattatactttaagtgctgggatacatgtgcagaacatgcaggtttgttacggaggtatacatgtgccgtggtagtttgctgtaaccatcaacccgtcatctacattaggtatttttcctaatgctatccctcccctagcccacaccctgacaggccccggtatgtgatgttcccctccctgtgtccatgtgttcttattgttcaactcccacttatgagtgagaacatgcagtgtttggttttctattggaatgatggtttccagcttcatccatgtccctgcaaaggacatgaactcatccttttttatggctgcatggtattccatggtgtatatgtgccacattttctttatccagtctgtcattggatgggcatttgggctggttccaagtctttactcttgtgaatagtgccgcaataaacatagtgtgcatgtgtctttatagtagaatgatttataatcctttgggtatatgcccagtaatgggattgctgggtcaaatggtatttctagttctagatccttgaggaatcaccacactgtattgtttcctgactttttaatgatcgccattctaactggtgtgagatggtatctcatggtggttttgattagcatttctctaatgaccagtgatgttgagctttttttcatgtttgttgactgcataaatgtcttcttttgagaagtgtctgttcatatccttcgcccactttttgatggggtggtttgtttcttctaaatttgtttaagttccttgtagattctggatattagccctttgtcaggtgggtagattgcaaaaattggttattttctctgctcctcaccctcctcccacccttaaccctcaagttggccccagtgtcttctttgtgtctgtgagttcttatcatctagctcccacttataagtgaaaacgtgtggtatttggttttctgtttctgtgttactttactaaggataatggcatccagctccatctatgttccaacaaaagatatggtctccttcttttcagtggctgcatagtattccatggtacatatgtaccacattttctttgtccagtctgtcattggtgggcatttaggttgattccatgtctttgctgttgtgagtagtgctgtatgtgtctttatggtagattgatgtatgttcctctgggtatatacctagtaatgagattgctgggtcaaatggtagttctatttttagctctttgaggaatccccacaccgcttcccacaatggttaaactaatttccactcccaccagtatcagtgttcccttttctccacaacctcgtcagcatctgttatttttttactttttaataatagccattctgactgctgtgaaatggtgtctcattgtggttttgatttgcatttctcgaatgatcagtgatatcacgcttttttaaagtatgattgttggccacatgtatgtcttctttagaaaagtgcctgttcatatcctttgcccacttttaaatggggtttttttttcttgtaaatttgtttaagttccttatagatgctgtatattagatgtttgtcaaatgcatagtttgcaaatattttctcccattctataggttgtctgtttactctgttgatagtttcttttgctgtgcagaagctcttaagtttaattagatcacccttgtcaatttttgcttttgttgtgatagcttttggtatctttgtcatgaaatatttgctcatttctatgtccaggatggtattgcctaggttgtcttccagggattttatagtttggagttatacatttaagtctttaatccatcttgagttgatttttgtatatggtataagaaaggggtccagcttcaatcctatgcatatgactaaccagttatcccaacaccatttattgaatagggaatcttttccccattgcttgtttttgtcagctttgtcaaagatcagttatagatgtgcagccttatttctgggctctctattcggttccattggtctatgtatccttttttctaccagtactatgctgttttggttactgcagtttggattatagttcgaagttgggcaacgtgatgcctccagctttgttctctttgcgtaggattgccttggctatttgggctctttttttggttccatgtgaattaaaaaaaaaaatttctgtgaagaattgtcattggtagtttgataggaatagcattcgacctataaattgctttgggtagtgtggtcattttaatgatactgattcttcctgttcgtgagcatggaatacttttccatttgtttctgtcatctctgatttccttgagcattgttttgtaattctccttgtggaaatctttcactttcctgattacctgtattcctaggtattttattcttcttgtggcagttgtgaatgggattgcattcctgatttggctctctgcttgactgtcattggtgtataggaatgctagtaatttttgtacattgattttgtatcctgaaattttgctgaagttgtttatgtggtgaaggagattttgggctgagactggggttttctatatagataatcatgtcatgtgcaaacagggatagtttgacttcctctcttcctatttagatgctctctatttcttgctcttgcctgattgctccagccaggacatccaatgcaatgttgaataggagtggtaagagagggcattcttgtcttgtgctggttttcaaggggagtgcttccagctattccccatccggtatgatattggctttggatttgtcatagacggctcttattattttgaggtatgttccttcaatacctagttgattgagagtttttaacatgaagtgatgttcaattttatcaaaagccttttctgcatctattgaagtaatagtgtgggttttatctttacttctgttaatgtgctgaatcacatttattgatttacatatgttgaaccaaccttgcatcccaataataaaaccaacttgattatggtggataagctttttgaagtgctgttggattcgatttgctagtattttgttgaggatttttgtatcaatgttcatcaaagatatttgcctgaagttttcttattttgttgtgtctctgccagactttgttattaggatgatactggcctcatagaatgagttggggaggagtccctcctcctcagtttttggaatagttttagtaggactggtaccagcttttacttacacatcaggtataatttggctgtgaatctgtctagacatgagctttttatggttggaaggccttttaatactgcttcaatttcagaactcattattgttctgttcagagatttaatttattcctggttcagtcttgggaggtgtatgtttccaggaaattatccatttcttctgtttcctagttgtgttcataggggtgtttatagaatctttgaggttttctttttatatttctgtggggtcattggtaatgtctcctttgtcatttctgattgtgtttatttggatattctctgtttttctttattggtttagctagtggtttatcaatctgagttattcttttaaagaaaaaatttctggatatgttgatggtttgtatgttctttcatgtctcaattttgttcagtttagctctgattttggtaatttcttgttttctgttagctttggggttggtttgcttttgtttttctggttcctctagttgtaattttaggtggttaatttgagatctttctaacttttaaaatttttattctatttatttatttagagaccaggttatgagactggctaatttttgtattttgggtagaggcagggattcaccatgtttcccaggcttatctccaactcctgggctcaagtgatccacctgccttggcctcccaaagtgctgggattacaggcatgagccactgcacccagccaagatcttgctaaatttttaatgtgggtgtttagtgccataaactgtcctgttaatgctgttttgtgtgttccagaaattttagcaagttgtatctctgttctcattagtttcaaggaacttcttgatttctgccttaatttcattatttacccaaaagtcattcaggagcaggttgtttaatttctatgtaattgcatggttttgagcaatttttaaaatcttgacttatatttttattgcgctatagtcctagagtatgtttcatattattttggttcttccgcatttgctgaggattgttttatgtccaattatgtggtcaattttagagtatttgccatgtggcagtgagaagaatgtatattctcttgggttagggtggagagttctgtagaggtctattagatccatttggtccaatgttgagttcaggtcctgaatatgtttgttaattttcttccttgatgttctaatactgtcagtggagtgctgaagtctctcgctagtattgtgtgggagtctaagtttatttgttggtctctaagaacttgctttatgaatctaggtgctcctgtgttgggtgcatatatatttagtatatttaggcttcttgttgaattgaaccctttaccattatataatgcccttctttatctttttctatctttattggtttaaagtctgttttgtctgaaattaggattgcaacccctgcttttttctgatttccatttgcttggtatattttccgccatccctttattttgagcttatgggtgtcattacatgtgagatggatctcttgaagacagcatgccactgaatcttgttttttttatccagcttgccactctgtgccttttaagtggggcatttagcttgtttacattcaaggttagtatcaatatgtgtggatttgatcctgtcattgtgttgttaactggttactatgctggcttgtgtgactgctttatagtgtcattggtacttaaatgtgtttttgtaatggtctttcttttctaaatatagtgctcctttcaagatctcttacaaggcagatctgttggtaacaaactccctcaacatttgcttatctgtaaagtatcttatttctcctttgcttaggaagcttagttcggctggatatgaaattctcagtggaagattttttttcttcatgaatgttgaatataggcccccaatcccttctggcttgtaggatttcatctgagaggtccactgttaacctgatggggctccttttgtaggcggcctgccctttctctctggcttcctttaacattctttcttttatttcagtcatggaaaatctaaggattatgtgtcttcacgatgatcttttgtaaaatcttgcaagagttctgtgtattccaacaaattccatttgttggaaacttaatttctaaatttatatattgatggcatttggaggtggagcttttagaaagtaattaggattagatgaagtcatcaaggtggatcccccgtaaaggaataagtgacttcataagaagagtaagagagctaagttagcacacttgttctgtctcaccatgtgatgccttttgccatatcattttacaagaaggccctcaccagatgccagtgccatactcttggacttcccagcctccaaacccataaactaaacctctattcattatagataatccagtttatggtatttagttacagcaacagaaaatgggctaagacaacaattaggcaggaaaaagaaataaaagccatctagattggaaaggaagtaaaactatttctaattcccagacaacataatcttatacagtatttacaaaatcctgtagattccactaaacgacaactagaactaataaacaagctcagcaaggttgtaagatacaacatttatatacaaaactcaactgtattctcatacatttccaatgaacaatccaaaatcaaattataaatataatcctattataaatattataaaaaggaatacaatacttaggaataaacttaacaaaataactgcaaaacatactctgcttgtccactgcaaactacaaaacattgctgaaagaaataagacacaaataaatggaaagacattttatgttcatacactggaagacttaatattgttaagatgtcagtactacccaaagtgatctaacagactcaacacaatccctataaaaatctcaatggcattttttttgcagaaacataaaaattcactctaaaatttccatgaaatctcaaaggaccccccagtagccaaaacaatcttgaaaaagaaagacattggaagtctgacaatgcctgatttcaaaatatattacaaaactatagtaatcaaaacagtgtggtactggcataaagacagacatattgacaaatggaaaggaatagagagccctgaaataaatccttttatatatagtcaaatgatcttcaacaagggtgccaaaatcactcaacaggcaaaagacagtttctttaacaaatgctattgtgaaaactggatatgcaaatgcaaaagaatgaagttggactcttaccaccatacacaaaaattaactcaaaatggattaataacttaaacacaagaccaacaaccatgaaagcactagaaggaagaaaacatacaggggaaagatttatgatattaaatttagcattatttttgtggatatgacatcaaaagcacaggcaacaaaagccaaaatagacaaatggaactagatcaaactttaaaacttctgtgcatcaaaggacacaatcaacattgtaaaagagcagcacttgcaaaccatatatctgatgaggggttaatatccagaatatgaaaagaactcttgtaatgccacaagaaataatccaattaaaaagtgggcagaagacttgaatagacattttttcaatgatgatagcaaataaccaataaacatgcattgctgcttgacatcagtaattattagagaaatagaaatcaaaaccacattgagatatcacttcacacccattacaatggctactatcaaaaaaaacagaaaatgttgccatagatgtggaaaaattggaacccttccacacttttattgggaatataatatgatgcagccactatggaaaacagtatggggttttctcaaaaattaaaaatagaaataccatatgattcagcaatcacatctttgcatatgtttctaaaagaattgaaagcaggatctcaaagaaatttgcacacccatattcatagcagcattattaagaagagccaagagatggatgttcatcaagagatggacagataaagaaaatgcaatttacatgcaaatgtagtataaaacaaaatattattcaaccttaagaagtatttccttcatttagcaacaggtatagcatgcaaatgtagtacaaaataaaatattcaaccttaaaaaggatttccttcctttttactgcaaatacaaatgcaaaagaatgaagttggactcatcaccatattaaaaaaattaaagtggattgaaaacttaaacacaagacgaacaactgtaaaggaaggaaaacctttttaaggttcgataatattttattttatactacgtttgcatgctacccctgttgctaaactgtgtacttaaaaattgttaggattaggtgagttttgctacaacctttaaaaagttttattctcaaaattgtaaaacattgttcacataaagaataaataaatagaaaaacatcctgtgtttattgatccgaagagttaatattagattgttaggatggcaatattcttgtaactgatctatgtattcaacacagaattaaatggagaaatttacaaaaactacagtcagcatgagatttctatttttctctcttacaaattgatgtgtcagacagagagcttaaggtttgatatggaaaatttgaacaacataattatcaaacttgattaagtaaacgttttatatgcaataatcagaaaatatctctatacattctttcaagaacacatggtacatttaccagaactgatgatgttttagaacaaattgtctcaataaattttaaagtaactctgggtttttatctaatcacaacacaaaattaatgtttaatagtaaaaaataattttaaaaattttatttggaagttataaagtacacttttaaataattcatatatcaaagaataaagtgtcactggaaattttggttttctgtcaaaccatgagatgcagccaaatatgttcagagggaaatttatagtttttaatgcttattttcaaaaagaaaaaaaattaagaagtgaggcccctaactcaagaagtgattaaaaaagaaaagcagaacttaattaaattaatgaagtagaaaacaaggaggatacatttaaaaataacttacagaacaggagaagatatatgcaatacttataactgaaaaaaaaaacaaaaactggtgtccagaatatccaaaaacaccctaacaaatcactgacaaaaaggcaaacaatcaattagaaaagggagtaaaagatttaaatagttcaacaaaagagaaactctgcatggtgaatcactatatgaataaatgctcaaccttcttagtgataagagaaatgaaaatttaaaacaccacaatgagatacctctacaccccatcagttgaacaaaaaattaagtatgacaactccaagtttgggcaaagatgtggagcatcaagagttctcatacagtgctagtgagagcataaattgatagaaccacatggagaaaataatgtgacattatccaactaaattgaagataagcctactgtagcagtctggatccaatcaggagatagaaaccccacaatagcctaaacatggaactttaatatcagacttaatacctatgattaaatagcaactataaaatatgaggaaagagtacctaaggaaagacaaacgtgaaagagtttcagatctcattggagaacgtgtgtttggccactagatagcaaaaaaaaaatctgctgatgtagccagaccacaggtggtctggagtttctgagcaaacaatagggaaccctctagtgtacaggtagggaagcaggcaatcagcaatacctagtgtggcctgcaataggaagctggggatgaaagcagaagaccagagcatacccatacacactagcccgcacaggaagtggcagctctgtgttgtgagcctctgtgccacagggggctgttgtgaaggtcatgtgggagctttggtttttatgtccagagggctgtgaagctgcaatattgcagagtaatctcaggccttggtggtttctagtggatgtcgtcacatccacacctctgaaaaaattgcaagaagtttctttatcctgcaatgtcccttcaacatcctcactgaaaaaaagttaacataatgctcactttaaaagagaagtacttgagagaattctattattagttgtagaccatatattgcagggtacatttagagctgaaaagtgatcaattgctaatggaaataccctgtaatttgaaatgcatgaatttgtgttggatacaccaacacatatataaaaacggtcatagacgttttgttttaattgccccaaatggacacaacacaatgctcagaatggataaatgattgtggtatacttatatgatggaataataacatcaattaaaatcaacaaagtagagcttgtgcaacaatatggctgaacctttcaaacataatgttaagtggaaaaaagcaagacactgtataatacaaattacatatcttagtcaattcaagctattgtaaaaatactatagactggatgccttaaacaacaaacatttatttctcacagttctaaaggctgggaagtgcaagataaagtattggcagatgtggtatgtagtggagccccactttttggcttgtagacttcttgctgtagcctcacatggccgctagtgaactctagtttctttctcttcttataaggacactaatcccatcatgggggctccacttccatgacctcatctaaaccttgtgacctcccaaagttcccacctttgaataccatctcattgagggttagggtttcaacatatgaactttggggagacagaaaccatgtagtctataaaattgcatgattccctttatatcaagtccccaactaggcaaaactaaactatattattcaaggttgcatacacaattagtaaaactgtagagaagtaaggaaaccactaccataaaattcaggattttactaacctttagaagggagggaaagggttatgatagagaaagaatatatggtgggaagggctttcagggtaccggaactatctcaatgtgatgatagttaagctgatgtttgctttatcaatgcttatttatgattcatactttatatataaattttatgtgcttttctgtctatatgtgttacatcttttaagaagaaaaacagtttatgccaggaaacaacaaaatccagccatgcccacccagagattttataggcaaagtatatcatacattgatggaaggaataatcctaatttatgcaattatttccaaagaatactttggagaaagctcttctttgaatcatgtatactccaatatatttgttcttaagaggttgggcaggattactataacctaaaggttctgggcaccatcccccaagattctgattcagtaggtctggggtggggcccaataatttgcatttttttttatttcaatagtttttggggaacaggtgttgttacctgaggatggtctttagtgttgatttccaaaattttggtacacccatcacccaagcagtgtacactgtacccaatatctagtcttttatccctcacccacctcccaccctgccccagtgagtccccaaaattcattatatcattcttgtggctttgcatcctcgtggcttagctctaagtgagagcatatgatgtttggttttctgttccttagttacttcacttataataatggtccccaaatccatccaggttgctgcaaatgccattatttcattcctttttatagctgggtagtattacatggtgtgtgtgtgtgtgtgtgtgtgtgtgtgtgtgtgtgtgtgtatacagatcacattttcttcatccactcgttgaatgatgggaatttgagctggttccatatttttgcagttgtgaattgtcctgctataaacatgcctatgcaagtgtctttttcatataatgacttcttttcctctgggtagacatagatacccagtcatgggattgctggatcaaatggtagatgtccttttagtttttttaaggaatctccacactgttttccacagtggttgtactagtttacatgcccaccagcaatgtaaaagtgttctctttcaccacatcaaggccaacatcttttttttttttttaattatggccatccttgcaggattaaggtcgtatcacgttgtggttttgacttgcatttccctgataattaacaatattgagcattttttcatgtttgttggccatttgtatatcttgttttcagaattttctattcatatccttagcccacattttgatgggattgttttattcttgctgatttgtttcagttccttgtggattctggatattagtcttttgtcagatgcatagtttttgaagattttcttccactctgtgggttgtctgtttactctgctgattatttcttttgctgtgcggaaccttttttattttgttaagtaccatctatttatctttgcttttgttgcatttgcttttgggttcttcgtcatgaactttttacctaagccaatgtctagaagggtttttctgatgttatcttccagaatttttatggtttcaggtctttggtccatcttgagttgacttttgcataaagtgagaggtgaggatccagtttcattcttctatgtggcttgctaattatccagcaccatttgttgaatagggtgtcctttccccactttatgtttctgtttgctttgtcaaagattagttggatataagtattggactttatttctggatactctattctgttccgttggcgtatgtgtgcctgtttttataccagtaccatgctgttttggtcaccatagccttatagaatagtttgaagttggataatatgataccttcagatttgttcttttcgcttagtcttgctttggctatgtgggctatttcatagttccatttgaattttaggattgttttttctagttctgtgaagaatgatggtggtatattgataggaattgcaatgaatttgtgcattgcttttggcagtatggtcattttcacaatattggttttccctatccatgaacatgggatgtgttttcatttgtttgtgtgatctatgatttcttttttattattattatactttaaattttagggtacatgtgcacaacgtgcccgtttgttacatatgtatacatgtgccatgttggtgtgctgcacccattaactcatcatttaacattaggtatatctcctaatgctatccttcccctctccccccaccccataataggccccgatgtgtgatgttccccttcctgtgtccatgtgttctcatggttcaattcccacctatgagtgagaacatgtggtgtttggttttctgcccttccaatagtttgctgagaatgatggtttccagcttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcagtaaacatacatgtgcatgtgtctttatagcagcatgatttataatcctttgggtatatacccagtaatgggatggctgggtcaaatggtatttctagttctagatccctgaagaatcgccacactgacttccgcaatggttgaactagtttacagtcccaccaacagtgtaaaagtgttcctatttctccacatcctctccaacacctgttgtttcctgtgtgtcatctatgatttctttcagcagtgttttgtagttttccttgtagagagctttcacgtccttggttagatatatcctaagttttgtgtgggggggttgcagctattgtaaaagggtttgagttcttgatttgattctcagtttggtcactgttgggatatagcagtactactgatttgtgtacattgatattctatcctgaaactttactggattaatttgtcagatctaggagctttttggatcagtctttagggttttctatgtataccatcatatcatcagtgaaaagcaacaatcatttaggagcaggttatttaatttccatgtattttcatgcttttgaggattccttttggagttgatttccacttttattccactgtggtctgaaagagtacttgatataattttgattttcttaaatttgttgagatttgttttggggtgtgtcatatgctctatgttggagaatgttccatgtactggtgaatagaatgtgtattctacagttattgggtagaatgctctgtaaatatattaattccatttgttctagggtatagtttaagtctattgtttctttgttgacttttggtcttcataatcggtctagtgctgtcagtgaagtattgaaggccccactgttactgtgttgttgtctatctcatttcttaggtctagtagtaattgttttataaaattggaacctccagtgttaggcgtatatatattttggattatgatattttcctcttggactagtcttttatcattatataatgtccctcttggtctttttgaactgttgttggtttaaagtctgttttgtctgatataaaaatagctactcctgcttgttttggcatccatttgcatggaatatctttttccaccgctttaccttaagtttatgtcagtccctgtgtgttaggtgagtctcttgaagacttattttcctggctttgctagagatctagacattcaaatagaagttcaaagaacacccaggaaattcgtcgcaaaaagatcatcacctagacacatagtcatcaggttatctaaagtcaatatgatggaaataattttaagaactgtgaggcaaaagcatcatgtaatctataaaggaaaacctatcagattaacgcaaatttctcagcagaaaccctacaagctagaagagagtggggtcctatctttagcctccttaagcaaaataagttgtttgaatgtctagatctctagcaaagccagggaaattttctttgattatttcctcaaataaattttccaaacttagatttctcttccttctcaagaaaatcagttattcttaggtttggtcatttaacataatctcaaactttttgaattttgttcatttttaaaaatttttttttctttgtctttgtcagattgggttaattcaaaagccttgtcctcaagctctgcagttctttcttccacttgtttgagcctattgttgaattgtttcatccatatcctattttattcttttaacttctttaagttagttttcacttttctctgctaccttcttcagtagcttaataatcaatcttctgatttgttttctggaaactcagagatttcgacttagtttggatccattgctggtgatctagtgtgatcttttgggggtgttatagcaccttgttttgtcatattaccagaattgtttctctgttttcttctcatttgggtagattatgtcagaggaaaggtctgggactaaagggctgctgttcagattctcttgtcccatggggtgttgtcccttgatatggtcctatccccccacttcccctagggatggggcttcctgagagccagactacagtgattgttattgttcttctgggtctagcctcccagcagagctaccaggctccaggctggtaccgaggagtgtctgcaaagagtcctgtgatgtgatctgtctttgggtttctcagccatggataccagcacctgcttcagtggaggtagcaggggagtgaagtggactctgtgaaggtccttggttgtatgtttgtttagtgcactggttttctctaatgctggttgtgctagtggttagttgacctttagccagaaggtggctctctcaagacagcattagctgatacaagcttgccctaaaattgcccatgtaactattcaggtttctcaggtgataggaaagaccatagagctcccaagagattatgtcttttgtcttcagctaccagggcaggtagagaaagaccatcaggtgggggcaggattaggtgtgtctgagctcagactctccttgggtggggcttgctgtggctgctgtgggggatggggtatggttcttaagccgatggagttatgttcccaggtggattatggctgcctctcctgcatcatataagtcacctggaagtgggggaaagctgatagtgaccagcctcacccagttcccacgcagccagcaaggccagtctcactcccaccaccagccccaagtttatattcaggcaaccagcaatcaccgctgagatcttgccccaggctacatgtctccttgctgagaattcaagcagggctttcaggcccagtcccttctcacctgccatggcttctgtgctcatatctgcacttctcattgatctctcacttctggattctgcccaggaaagttcatgattggtcaaaattattacagagttcaactggacgttttcttctctctgtggttctttccgaattccactggcagccctccccaaggacccttgtgagaaaaagtcagaaatggcttccctggggatcaggagtgtccacagggctcttactgctgcttcttctacctttacattttgctgggctctctaaattcatttcaactctaggtaaggttaaatccttcttctgtgatctgaattttcaggttccccagtgaggatgtgtgtttggagatggaccttccccctgacactttgggcactcccagttttttggctgtctcacagagcttgcagtggcaagctgtttccttcaaaaggtctgtgaattatttcagttttcctggtacattcttgtggtcgttcttggagcaaaagtttatgatgtaagcctccacatactgttctgttcgtccaagtgggagctgcaagttagtcctgctttgtagccacgattttccccaatattttgcatttctgatagttgccgtgagactttgatgttgctggtctaggaaccgtagtttgagaacaactgttctagcataattgaaagaaggttatctggccatagtcaaaccatcaagggaaccaacaaatataaaagcaaaaattcccaaccaaaaggcagtaagttcgaagattcaagaaacatcaagccacacagatgaaaaagaaccagaagaaaaacaatggaaattcaaaaagccaaagtgtcttcttacctcaaaatgaccacactagatcccttgcaatgtttcttaaccaggctgaaatggctgaaatgacaaacattgaattcagaatctggatggcaatgaatatcattgagattcaggagaaaggtgatacctactccaaggaatctaaggaatacagtaaaatgatacaagagctaaaagatcaaaatagccattttaagaaagaaacagacttatctgatagagctgaaaaactcactacaaaaattccataataccatcaggattaacagcagaataaaccaagctatggaaataaactcagagcttgaagaccagttcttcaaatcaactcagacaaaaataaaaaagaatgaacaaaacctccaagaaatgtggggttatataaagggaccaaacctatgaatgactgacatccctggcagaaagggagcaagagcaaggaacttgtaaaatatatttaatgagactgtgcacaaaagtttccccagccttgctagagaggcgaatattcaaatgcaggaaatttagagaaaccctgtaagatactatacaaaatgaccatccccaagacacatagttatcagattctccagcgtcaacacaaaagaaaaaaatactaaaagcagctagagagaataggaaggtcactgacaaagggacccccatcaggctaacaatggacctttcagcagaaacactgtaagccagaagagaatgtggcctatattcaacattcttaaagaaaagaaattttaaccaagaattttatccagccaaactaagcttcataagaaaacgagaaataaaatctttttcagaaaagcaaatgctaagggaatttgttaccatcagacttaccatacaagtcctaaaggaagtgctaaatgcagaatcaaaagactgttaccagccaccataaaaacacacttaagtatatagactgtttacattataaagcaactacacaatcaagtttgcatagccaccagctaacaatacaatgacaggaacaaatctgcacatagtaatattaaccttgagtataaatgggttaaatgccccacttaaaaggcacacagtggcaatttggataaagaagcaagactcaactctatgctatcttcaagatacccatctcatatgcagtgacacccataggctcaaaataaagggatggagaaaaatctaccaagcaaaggaaaaacagagagaagagtaggggttgctattcttatttcagacaaaacagaccttaaaccaacaatgataaaaaaagacaagggcattatataatgataaagggtttaattccacaggaagacttaattatcctaaatatatatgcagccaatactgaagcactcagatttataagacaagttcttaaagaccttgattccacaaagagacttagattcccacaaaataatagtgggacactaaaacaccccactgacagtgttagacagatcattgaggcagagaattaacaaagatattcaggacctaaacttgacacttgaacaaatggacctgacagacatctgcagcacactccacccaacaacaacagaatatacattcttctcatctgcacatggcatatagactaaaatgaaccacatcttgaccataaagcaattctcaacaaattcaaaaataaaatcataccaacctacactctcggaccacagtgcaatgaaaatagaaatcaatagtgaaaagatatttcaaaattatacaattacatggaaattaaacaaccttctccttaatggcttttggctaagcaatgaaattaaggcagaaatcaagaaattctttgaaaataatgaaaacaaaagtacaacataccagaatctctgggacatggtgaaagcagtgttaagaggaaaatgtacagtgctaaatgctgacattaaaattgccaatccaattacctccacctggtcctgcccttgacacatggggatcatggggattacaattcaaggtgaggtttgggtgggaacacagatccaaaccatatcagcactggtacaaaaacaaaaacacaaataatctcaaataaacaatctaacattataccaagaggatgtagaaaaacaagagcaaaccaacccaaaagatagaaggagaaaagaaataaccaaaatcagaacttaacaaagttaatgtgcaaaatacatacaattgttttcaaacatcaatgaaaccaaacgttggttttctgaaaaaataaataagattgaaagagtgcttgctagacttacaaaaaaagagagaagatctaaataaagacaatcggaaatgaccaaagggacattaccatcaaccccacagaaatataaaaaaccctcaaagactaaatgaacacttctgtgcacataaactagaaaacctagaaggaatggataaattctgggaaacgtacaacctctcaagattaaacctggaaaaaattgaaaccctgaacagaccattaatgagttccaaaattgaatcagtaacaaaaacctgtcaaacagaaaaagccttagattagatggattcacagctgaattctaccatatgtaaaaaacaaaaggtattaccaatcctactgaaactattcaaaaaaaaaaaaatcaaaggaggagggactcctctctaacttattctataaggctagcatcattctgatacacacacacacacacacacacacacagaaattctggccaacattcctggtgaacatgtatacaaaaatactcaacaaaatgctagcaaacgaaatccagcattgtatcaaaaagctaatccaccatgatcaagtagcctttattcttgttctgcaaggttggttcaatgtacacaaatcaataaatatgatttgtcacaaaagcaaagcaaaaaacaaataccacattatcatttcaataaatgcagaaaagacttttgataaaattcaacatcctttcatgttaaaaaaaaaaaaaaaaaaactaggtattgaagtagcatacttcaaaataataagagccatctttgacaagcccacagctaacatcatactcaacaggcaaaagctggaagcattccccgtgagaactgaaacaagaccaagatgcccactctcaccactcctaatcaacatagtactggacgtcctagccagagcaataaggcaagtgaaagaaataaaggtttccaaatagaaaaaaaagaagtcaactatctctcttcacaaacatgattttgtacctagaagactccatagtgaacactgcatgttctcactcataggtgggaattgaacaatgagaacacttggacacaggaaggggaacatcacacactggggcctgttgtggggtggggggtgggggagggataccattaggagttatacctaatgtaaatgacgagttaatgggtgcagcacaccaatatggcacatgtatacatatgtaacaaacctgcacgttgtgcacatgtaccctagaactcaaagtgtaattaaaaaatatatatatataaaagaaaactccatagtgtctgtccaaagcctcctgcatctgattaaaaaaaaaaacttcagcaacattttagggtacaaaatcaatgtataaaactcagcatttcaatacatcaataacatccaagctgagagccaaatcgtgaatgcagtcccattcacaatagccacgaaaagaataaaatacctagtaatacagctaaccaaggaggtgaaagttctccacaaggagaattacaaaacactgctcaaagaaatagagatgatacaaacgagtggaaaaacattccgtgctcatagataggaagcatcaacaccattaaagtagccatactgtccaaagcaatttacagattaaatgccattcctatcaaactgccaatgacgtttttcatagaattagaaaaaaccattctaaaattcatacagaacatgaaaaagccagaataaccaaagcaagcctaagcaaaatgaacaaagctagaggcatcagacactacctgacttcaaagtacactacaaggcaacagtaaccaaaatagcatggtacttgtattagtccattttcatactgctataaagaactgccccaaggttccaagatggctgaataggaacagctccagtctgcagcttccagcatgagcaatgcagaagaccagtgatttctgtatttccaactgaggtaccgggttcatctcactggggcttgtcagacagtgggtgcagcccacagagcagggccgggcatcacctcacccgggaaatgccaggggtcgggaattccctttcctagcaaggggaagttgtgacagatggtacctggaaaactgggacactcccaccctaatactgtgcttttccaatgaccttggcaaacggcacactaggaggttatatcccatgcctagctcagagggtcccacacccacagagcctcgctcactgctagcacggcagtctgagatggaactgcaaggcggcagcgaggctgggggaggggtgtctgccattgctgaggcttgagtaggtaaacaaagcggccaggaagctccaactgggtggagcccaccacagctcaaggaggcttgcctgcctctgtagattccacctctgggaattgaactcagctctgcaccaagcggacctaatagacatctacagaactctccaccccaaatcaacagaatatacattcttctcagcaccacactgcacctattccaaaattgaccacatagttggaagtaaagcactcctcagcaaatgtaaaagaacagaaattataacaaactgtctctcagaccacagtgcaatcaaactagaactcaggattaagaaacgcacccaaaactgctcaactacatggaaactgaacaacctgctcctgaatgactattgggtccataacgaaaggaaggcagaaataaagatgtcctttgaaaccaatgagaaaaaagacacaacataccagaatctctggtacacatttaaagcaataaatgcccacaagagaaagcaggaaagatctaaaattgacaccctaacatcacaattaaaagaactagagaagcaagagcaaacacattcaaaagctagcagaaggcaagaaataactaagatcagagcaactaaaggagataaagacaccaaaaaacccttcaagaaatcaatgaatccaggagctggttttttgaaaagatcaaaaaaattgatagaccactagcaagactaataaagaagaaaagagagaagattcaattagatgcaataaaaaatgataaaggggatatcaccatcgatcccacagaaaaacaaactaccatcagagatactataaacacctctatgcaaataaactagaaaatctagaaatggataaattcctggatacatacaccctcccaagactaaaccaggaagaagttgaatccctgaatagaccaataacaggttctgaaattgaggcaataattaacaccctaccaaccaaaaaactccaggaacagatggattcacagccgaattctaccagaagtacaaagaggagctggtaccattccttctgaaactattccaatcaatagaaaaagagggaatcctccctaactcactttatgaggccagcatcatcctgataccaaagcctggcagagacacaacaaaaaaagaattttaaaccaatatccctgatgaacatcgatgccaaaatcctcaataaaatactgccaaaccgaatccagcagcacatcaaaaagcttatccaccatgatcaagtgggcttcatccctgggatgcaaggctggttcaacatatgcaaatcaataaacgtaatccattatataaacagaaccaaagacaaaaactacatgattatctcaatagatgcagaaaaggcctttgacaaaattcagcagcccttcatgctaaaaactctccataagctaggtattgatgggatgtatctcaaaatgataagagctatttatgacaaacccacagccaatatcatactgaatgggcaaaaactggaagcattccctttgaaaactggcacaaaacagggatgccctctcccaccacccctattcaacatagtgttggaagttctagccagggcaatcaggcaagagaaagaaataaagggtatccaatgaggaaaagaggaagtcaaattgtccctgtttgcagatgacatgattgtatatttagaaaaccccattgtctcagcccaaaatctccttaagctgataagtaacttcagcaaagtctcaggatacaaaatcaatgtgaaaacatcacaagcattcttatacaccaataacagacaaacagagagccaaatcatgagtgaactcccattcacaattgcttcaaagagaataaaatagctgggaatccagcttacaagggatgtgaaggacctcttcaagaagaactagaaaccactgctcaatgaaataaaagaggacacaaacaaatagaagaacatttcatgctcatggataggaagaatcaatatcatgaaaatggccatactgcccacagtaatttatagattcaatgccatccccatcaagctaccaatgcctttcttcacagaattggaaaaaactactttaaaggtcatatggaaccaaaaaagagcccgcattgccaagtcaatcctaagccaaaagaacaaagctggaggcatcacactacctgacttcaaactatactacaaggctacagtaaccaaaacagcatggtactggtaccaaaacagagatatagaccaatggaacagaatagagcccgtggaaataataccacacatctacaaccatctgatctttgacaaacctgacaaaaacaagaaatggggaaaggattccctatttaataaatgatgctgggaaaactggctagccatatgtagaaagctgaacctggatcccttccttacaccttatgcaaaaattaattcaaggtggattaaagacttaaacgttagacctaaaaccataaaaaccctagatgaaaacctaggcaataccattcaggacacaggcatgggcaaggacttcatgactacaacaccaaaagcaatggcaacaaaagccaaaattgacaaataggatctaattaaactaaagagcttctgcatagcaaaagaaactactatcagagtgaacaggcaatctatggaatgggagaaaatttttacaatctacccatttgacaaagggctaatatccagaatctacaaagaacttaaacaaatttacaagaaaaaatcaaacaatgccatcaaaaattgggcaaaggatatgaacaggcccttttcaaaagaatacatttatgcagccaacagacacatgaaaaaatgttcatcatcactggccatcagagaaatgcaaatcaaaattacaatgagataccatctcacaccagttagaatggcgatcattaaaaagtcaggaaacaacaggtgctggagaggatgtggagaaataggaacacttttacactgttggtgggactgtaaactagttcaaccattgtggaagacaatgtggcgattcctcaaggatctagaactagaaataccatctgacccagccatcccattactgggtatatacccaaaggattataaatcatgctgttataaagacacatgcacatgtatgtttattgtggcactattcacaatagcaaagacttggaaccaacttaaatgtccatcaacaatagacctgataaagaaaatgtggcacatatacaccatggaatactatgcagccataaaaaaggatgagttcatgtcctttgtagggacatggatgaagctggaaaccatcattctcagcaaactatcccaaggacagaaaaccaaacactgcatgttctcactcataggtgagaattgaataatgagaacacctggacacaggaaggggaacatcacacaccggggcctgttgtggggtggggggaggggggagggatagcattagaagatatacctaatgtaaatgacaagttaacgggtgcagcacaccaacatggcacatgtatacatatgtaacaaacttgcacgttgtgcatatgtaccgcataacttaaagtacaataatggaaggaaggaaggagaaggggaaggggaaggggaaggaggggagggaaggaaggaaaggaaaggaaggaaggaaaagaaagaactgcccaagattgggtaatttataaaggagagaggttcagttgactcacagttcagcatggctggggaggcctcaggaaacttacagtcatggtggaaggtgaacgggaagcaagacaccttctttacagggtggcaggacagagtgagtgcaagcagggtacatgccagatgcttataaaaccatcagatcttgtgagactcactcattgtcatgagaacaacatggggaaaccacccccatccaattatctccacctggtcccgcccttgacacgtgggtattatgcagattacaattcaaggtgagatttggatgggaacacagagccaaaccatatcagtactggtacaaaaacagaaacacaaatcaatggaacagagtagagaacccagaaataaagctgcacacctacaatcatctgatctttgacaaagttgacaaaaacaagcaatggggaaaggactccctattcaataaatggtgctgggataactggctagccatatacagaagactgaaactggaccccttccttataccatatacaaaaatcaactcaggatgcattaaacacttaaatgtaaaacctagaactataaaaaccctagaagaaaacctaggaaataccattctagacataggccttggcaaatatatcatcaggaagactccaaaagcaattgcaacaagaacaaaaattgacaagtgggacctaattaaactaaagatcttctgcacagcaaaagaaactataaacagattaaacagacaacctacagaatgggagaaaatatttgtaagctatgcaactgactctaatatccagaatctataaggaacttaaacaaattaacaaggaaaaaaatttaaaaatgggcaaacgaaatgaacagacacttttccaaagaagatgtacatgcagccaacaagcatatgacaaaaatgctcaacatcactaataattaaacaaatacaaatcaaagccacaatgaaataccatatcacaccagtcagaatggctactattaaaaagccaaaaatatcagaagctggtgagattgcagggaaaatgggacactaatacactgctggtgggaatgtaaattagttcagccactgtggaaagcggtttggagatttctcaaaggatttaaaaacaaaactaccattcaacccagcaatcccattactgggtatatacccaaacgaatataaactgttcaaccataaagactcatgcatgcttatgttcatcacagcactattcacaatagcaaagacatggaatcaaccttgatgcccatcaacagtggactgggtaaagaaaaagaggtaaatatacatcacgcaatactatgcagccatgagaaagaacaaaataatgtcttttgcagcagcatggatgtagctggagactattatcctaagtaaactaacgcaagaacagaaaaccaaatacctcatattctcacttataagtagaagctaaacactgagtacacatgaacacaaagaagggaacaactgatgccaaggcccacctaaggatgcagagtgagaggagagttaggattgaaaaactacctcttaggtactatgcttattacctgggtgatggaataatctgtataccaaactccatgacatacagtttaccattgtaacacacctgcacaggcatccctaaaacaaaacttgtaaagaaaataccaaaatacacattgacaaaagaaaaagaagatactaaagacaacctaaataaagagaggtcttcatagatggaaaggctcaatgttacaaaaatgttagttctccttaatataaactatccaatacaattccagtttaaaaaattgaagagttgagccttttaaatttttttagtattcataacaaaaacaattttaagtttaatagcacaggaggaaaagtaatgaagcttgaaaattaaaagggatacagaatcctaatgacactttgattgactatctcataaagaatcagacatcaggcacagaaaattgccacattttagattcttggctacttgcattttgctagtttttcatatgattattaactataaaacctataaacgagcttttattaggaatcaaagaaagggaataaaggactagggaggatacctcaacctcctttgccaggtgtatggagtttttaaaaaaggttagtagcagctataagggcaaaggaaaacaactgagtctcaggggtttgccacaaggaggaaatgaggttatgaggaacccacatgggcctggagaagcttgtgacattttctcataggctatttacagccaatgccatcacaatacaaataaatttaaaacagtgaagaaaaacagaagtaagctagttttactgattgtagagattactctgtgtgctatgatcaagttccaaatttgtttgagttttctagctgctagaaataacaaaaaggaaaatatgacaaatgttacagtgttcaaaagtagaaatgaggcaacatgttaagtccacatgaaatccctaagtagaatgtatgagaaatagctttcagtctgggttcctacaggcaaggaacaggtgccatctccagctgagtcaagcaaaagagtaattcgctaaacgatattgcaatagctcacaaaatctactaggaagaactgaagtagaggctcaaggctaagccactaggaaagacacactgaagcatgttttagaattggtctggagataaaacagcttcctccagttccacagatactaccatttccacctgctaagctagtgtcccttcaaacccttgtttcctgtagctcatgagtcagatcccatctggtagcatttagttcagagtcttaagtcgcatgcctatgccctacctgcaaaagaggaaggaaaagtaagcatctggtatttttagctcctataatggatcatccacacttagcacatgtctgtaatactatgaattccccaaacataaaaactagttatactggtacacaaccaaaacaacatgacaaatgtgacaataaccatacaccatccactttcaagttttctacataaccagtgaagtcaatccttagagggacttaaattaagattacaaattgttacttgttcccttatgaactttctgacctaagtattctcaatccaataatgtagttataatcctgcatttatttactgttttcatcagggtttttaatacatccatatatgtaactttcttggatcaatttaacttggtctaggttattcttggatctaccagaacagaacccagaatgcctggaggtgtggatagaatagaaaatctcttttattacctttaagggctgttaaacaaaactgaattcaccagttacaaaagcaaatgattaaggtaagaacagaaatatcaacacattatgcttgtttactttaaaatgaaactatcttctatataaataaaaactgaaattcccaccaaaatgtaaagaatttaaaaggtaaattgtaaacattataaaaaggcattgtggaaaagatgaattcaactaaatgtgcagctatctgaaaatgaggctgtgttgtcttctccttaagtatagtgattacaaatgaggaaggaggattggaggatttccggctgctttctgtagcattgaatggggcctgctttgttagatgacttcaattgcaggatatttcagaaggtggatacatggactatactatatttagactccagctgccagtgagtctgggggaggcatacttaggcttgctgcaaaacgacgatccatggctttcgtgaacaagttatcctgaaatatatgacaaaagatttttttttaaaaatcttcaggcccaactcagaaacatcctttactgataatatgcaaaggagaatttccagaagaaaatgcttctggatagaggagatggaaaatattgaacagagttgttgggagaagaaagtccttttcaacttctcacattgctgccatctgtcctagagacactctgagctacccccataacatcattaaaaccacttctctgggggtcttgctctgttgaacccaggcactgtatgagtcatttcctgaaaatattgaacagactcattgggagaagacaatccttttcagcttctcacattgctgctcctgttccagagacactctgagctacccttataatgaaatgcgaaaagttcccttgtcactctcaaagggcatgcgatgagggagtggctcgctgctgctcaaacctctagggaagcatacagatgggcaggttgcggagctccgaccccatggcagtgtctaggggtgaatatttacagctcctgaagccctagtgggcatgagttacagggtgctcttttagtttagctgtctgtaggcggcttgtgttagctcaagtagaccccctttcttatcacaaggacagaggatttctgtatcccgggttcttgccttgatgtactggaagaatcacacgtggacttggagaattagtgcaaggttttattaagtagaagtagctctcagcagatgggggagccagaaaggagaatggttttccccttgggtcaggccactcggcagcctgggcggcctgggctgtcctccgactgccctggccaaactccaaggcgttctgctggtcagtggcctgccagtgtgctggtgcctgctgatgtgctcctctcaacatccagctgcctgtgtgttcctctgctgatgtggtcctctccacgttcagccgcctgtgtatctgcctgcgagggtgtcaggcacaggattagaggtatggcaggccagggtggtcttgggaaatgcaacatttgcgcaggaaaacaaaaatgcctgtcctcgcccaggtcattggggtggagccctagccagggaccacgacctcctcctctacccagcatttcccttccccacttccgtatcatttaaagggaccatgctcttcccttcccagcactcccatatcaatagtatcatcaaaaaccacttctctgctggtcgtactctgttgaacacagacactgtataagtcactttctaccaccaatccagacaggcctcagtcattgttgaacagcatgaacaaattatcatgactcactaaaaagaaaaatatatcagccagtatgaaacagagaaaacagggcaaaaagagatttatctgactcatgagattgttttagttgttgttgctgattagtaaggttttttaacaccaaatttttcagcatataattgtctcgatctacttagaacatcattaaagtcaacataatttgtccagggattgtaattttatggtggaaaatgtccaaaattgcttatagctattatcattaagtttttacctactcattattccttagtgaatatgaaatgggagaagtgttctcttatccttctcacagggtatgtgacggggtgtggctcacttctttggtatcccgctgctcaaacctctagggggagcatttttggggctccaactccatggcagtgtctagagttgtttacagctcctaaagccccagtgggcgtgtgttacagtgtgctcttttagttttgccatctgcaggcagcttgtgttaatcagctcaattagaccctccaccttattgcaaggacagagggttttctgtatcctgggttccttccctagtgtattggaaaaatcagatcacacgtgggcttggagaatgagtgcatgagtgcaaggttttattgagtcgtggaagtagctctcagcagatgggtggtgagccagaaggggaatggagtgtcttagcgtccagttgcctgtgtgtgtgcccgctagggtttcgggggtttttacaggcacaggatggggggcgtggcatttccctgcccccctccctgtatcaaatagactgcagtttaaacataaggcaataaattaaaaccagcataaattgaaaaaaagtttaaattagttatgtttctcccctgcaaacttaaaaaacacacacacataaaatcactgtcttttccaggaacatggaagactagaaaatataaaattttttcactacaggaggttagaaatgctggacaaaatgtagcaaacactgtgttaagtgcataggtgagagttcaggaaagtgaaataattcccaagtgacccaaaacaagagggaactgaaaaacagcactaagagagaaagaaggagcttctgttactaggaatcaagatttgggttatacctgctgctccctgatggagacaagactttctgagactaagaaaataaggactcagaattgaaatccctacacagaaccagatcatttggagagctatacaatgatggcaaggagatcctagaaaatactgcaaagggagatgacaacacttatattaccatagtggctttgggtggggagaaatattttgtgtaaaaggcagctttcaagtgggtttggtatttattttagttacatggtatgagtaccttcaagctgagaaattaactgaataactggttacaaattggcagtatttttgtgaggccagaaagaaacaaacagaagcaaaacatttctaaagaattcacctaaaacccagactacacaagatttctataggtaaaacacttcttaaaatgaacttgtcttccaaaatacaaaactcaagaaggaacaatcttccacgcacaaatgttagcagaagaagagatagaattatcagctcaaatttccaaataaggataagatgtcaaagcaggaaatgaaaacgggataaaagaaaatatgtatatatgtttttaaaatatactttagaaaacaaagtagaattgaagacgtgaaaaaaaacattaaaaataaaaatcattgaaagggttaaacgtcagactgaacacaactgaagagagaatttgttaactggataatggatttgaagaagttacccagaatgcacgagaggagagaggaggagagcagagaggggagagaggaggagagcagagaggagagagaagatgcaagaggactgaagggctgacataaaatctactaagagggccagacagaaagaacagagaaaatggaggattagtgggcaatatttgaaggaaattcaatgaatgaaaatctttgccaaattatagaaacacttaaatacttagatttagaaaagaaagtaagttccaagctggaggaatgaaattaatttagcttaaattaaaagcaactaaagataaaatgataatgattatctataaaagaacatttattggtataacagcaattatttatgtcagtagcagtaatacagatataaattaatggaaacaattaccagaatatagagtaaaacatgccctttgattttaaaaataaatgctttttgccaagaaaaaagatggaatcatctcctgtcaaagaatgcttggcagtaattcagtaaattaacagaatgtcctggaaactgaaagatgaacccagtaattctaaactgtatgtcatagttattttccaccaactaagggtatatgattgtatgaaggaatgtggttgggttaagggaggtgagtgggtatgcttattgaagaaatagcatgtgatgacaaagcacaatcccagatgttgaagtcatttcatctagagtttggatatttagactatgtgaacccggtggtggtcagtagtgtttaacttatattaggttctaatgcactaacctgtaaaggctgtgacataatgctcttagtgattaaatagtttgtatataaggctaggcgcgatggcttttgcctataaccccagcactttgggaggccaaggcaggccgaggtgggcagattgcttgagctcaggagttcaagaccagcctagccaacatggcaacaacccatctctacaaaaacctacaaaaattagctgggcatgatggcaggtgctgtagtctcagctactcaggaggctgaagcgagaggatggcttgagcctgggaggctgaggttgcagtgagctaagatagcaccactgcactgcagcctgtgtgaaagagtcagagcctgtctcaaaaacaacaacaaaaaaaattatttgtatgtaataaaccaaagctagcaatgtgtttcacatactttccttaaatttcagggatatcctttctcataaataatacctgtgtgggtgttttttttttactacaaaagtaattcctggtggtcatagaaaatctgaaagacatatataagtcacaagaaaaaattttaaatttcctttactcttaccacccagagaaaatattggtcagccttttaggacattttaagttgattttaatttttttaattcaactttgtatttcaagataattgctaacatgcaagtctcaaataatagactgatcttgggcaccctttacccagtttctcccaatggtaacatctttagtacctttagtatagaaaaactatagtacattcaatggtaggctgtcacagaaaaaaaaggaaaagaaaagctatagtacaatatcacagccatgatattaacattgatatagtcaagatacagaacatttcattcaccacaaggatccctgaagttgttctttgatagtcacactcactttccttcttccctcactccttccttaatcctggtaaccactgattctttctccatgtctatactttcatcatttcaataatgttatataaaatggaatcatacagtatgtaacattttgggattgacttttttgtttagcataactctgtggagattcacctagattgttgcctgtatcaatatttttattccattctattgctaaatagtgttgtatggtatggatatgtgtaaccattcacttgttggaggacatttgtgtgtttccagtttttgattacggtaagtaaagttgctataaatattcatgttcaggttttttgtgttaaatgtgttaatttctatgagataaatgcccagaagtgaaattgctgggtcatatggtagttgcatgtttagtttcttaacaagctccaacttcatatcattacatttgaagtaagtttcttatatagtagatcatgtttttaaatccgctctgacaatctctgtcttttaatttgtgtagttagaatagtgttatgacttaacactgacattttttgttgttttcctctatttgttttctctagtttttgttttagttttccttttcttgcttccctacaggttacttgaatattttaaaactttattttaatttaggtacagtgtttttgagcatatgtctttgtatagcttttttagtgatattaaattatacttgatattacattatatatacataacttatcacagtctattgtgtcattattttgaatgaaatatggaagtctcatctctttatattcccttccccttccccatttatagtataattattataactatttcctgcccatatatttggaaccacatcaatcagtgttataacttttgcttaatctggtaaacataacaacaaaatttaagaagaaaaggaaaactaattacatttatgcatatttttgtgtactatctttattccttcttgctgttttgaggctccttctttcatcattccttttctgtttagaaaaattcctttagcctaaaaggagtaggtctgctagtgacaaattatcttagtttccctttaactgagaatgtcttaattttcccttcagttctgaagtatatttttactgggtataggattctgggttgacaattcttttcttttagcatttaaaaaaaatattgtgccacttccttcctgccgtgaataagacatttatattgctgatgttaaggaataagagaaatatccaatgttgaaagagagtgcaagagaatgtatatagtccatatagaattaaatctgtgtcatggtggggtactctataatggttttgctgttcagtatagagcttgggcattctcaaatttaatcttcatgcattaagctattcaaaaccaactacaaacatgcttgatatgtagtgtgttatatttctaaggcatatatttaccttgtggtgttatgaatttgttgtgtaagaggcatactaagctaataagtaagcctagatgcccattcagtgtagaatctatgtggcctgaaaagggagagaaagattaatggtaagtattaaaataactgtgctaagcataaaaatagctaacattcatttaacactttccatgtgccagatagtatggcattcatttaacaggtgttaactatttttattctcacaatacattgtttgaggcagataatactaatttccccactttatagatgagaaaactaaagctcgggatgttatgtaacttgcccaagccacacataataacagtggcataaccagaattcagaatttaaatccatacagtctgtctttgattccatgctgtctatcctgtttaacttttacatgacaaagatatcttttacagcattaaattgcaccagggaactctaacccatctggcccgggtcagaaaagggacaaaatgtcaacttttaagtattcaaaaatggtatttgtttctttcatttattcatttgctatgtagcaatcaccattgtataatatctccataagaagatattgtttgaaaggaaatccatcatttattaaaaatatgtataaaacacttacaatgggccaggcattgttctaagtagataagatacataaattaccaaaacacacaaagattcacaccattaaagagtttgtatcttagcatgagggaggaagaaaataaacaatagctaaaaaaaaagaaataaattatatagtatatttgaaagtgaagatgaaaaaaataaaactagtgtaggtaagtgtgatcatcagagaagcaagcaacattaaatggggtggtcactattggaagatgacatatgatgatgagagaatttgtctttgaggaagattccagctagagaagacaattctatatccctaaattgggaaagcacatgcatgcctgaagactggcaagagggctagtgtatggaagtaaatgatcccgtgaaagagtagtaggaaataaagtaaaagagacatgtataatcatgaaaatcactgaaaggtttggagatattgtggggggagtccttgtttgttggttttttaatagcagtgatataattcacatatcataaagtttataaagtatacaattcagtagtttatatatattcacacaggtgtgctaccagtatcacagtccaactccagagtatttccatcgctctccaaaatcaccatatctattagcaaccactcttcaagtccgcatcccccagcctttggaaaccacagatttcctcaccgcctctaagaaattgcctattttgaggctcaaagtaaagggttggaggaagatctaccaaccaaatggaaaacaaaaaaaggcaggggttgcaatcctagtctctcataaaacagactttaaaccaacaaagatcaaaagagacaaagaaggccattacataatggtaaagggatcaattcaacaagaagagctaactatcctaaatatatatgcacccaatacaggagcactcagattcataaagcaagtccttagagacctacaaagagacttagactcccacacagtaataatgggagactttaacaccccactatcaacattagacagatcaatgagacaaagttaacaaggatatccaggaattgaattcagctctgcaccaagcagacctaatagacatctacagaactctccaccccaaatcaacagaatatacattcttctcagcaccacactgcacctattccaaaattgaccacatagttggaagtaaagcactcctcagcaaatgtaaaagaacagaaattataataaactgtctctcagaccacagtgcaatcaaactagaactcaggattaagaaactcacacaaaaccgctcaactacatgtaaactgaagaacctgctcctgaatgactactgggtacataacgaaatgaaggcagaaataaaaatgttctttgaaaccaacgagaacaaagacacaacataccagaatctctgtgacacatttaaaacagtgtgtagagggaaatttatagcgctgaatgcccacaagagaaagcaggaaagatctaaaattgacaccctaacatcacaattaaaagaactagagaaggaagagcaaacacattcaaaagctagcagaaggcaagaaataaccaagatgggagcagaactgaaggagatagagacacaaaaaacccatcaaaaaaatcaatgaatccaggagctggttttttgaaaagatcaacaaaattgatggaccactagcaagactgataaggaagaaaagagagaagaatcaaatagatgaaataaaaactgataaagggagtatcaagaccgatcccacagaaatacaaactaccatcagagaatactataaacacctctacgcaaataaactagaaaatctagaagaaatggataaattcctcgacacatacaccctcccaagactaaaccaggaagaagttgaatctctgaatagaccaataacaggctctgaaattgaggcaataattaatagcttaccaaccaaaaaacagtccaggaccagacagattcacagccgaattctaccagaggtacaaagaggagctggtaccattccttctgaaactattccaatcaacagaaaaagagggaatcctccctaactcattttatgaggccagcatcatcctgataccaaagcctggcagagacacaacaaaaaaagagaattttagaccaatattcctggtgaacatcgatgcaaaaatcctcaataaaatactggcaaaccgaatccagcagcacatccaaaagcttaatcaccatgatcaagtgggcttcatccctgggatgcaaggctggttcaacatacacaaatcaataaacgtaatccaccatataaacataaccaaagacaaaaaccacatgattatctcaatagatgcagaaaagaccttcgataaaattgaacagcgcttcatgctaaaaactctccataagctaggtattgttgggatgtatctcaaaataataagagctatttatgacaaacccacagccagtatcatactgaatgggcaaaaactggaagcattctctttgaaaactggcacaagacaggggtgccctctctcaccactcctattcaacatagtgttggaagttctggccagggcaatcaggcaggagaaagatataaagggtattcacttaggaaaagaagaagtcaaattgtccctgtttgcagataacctgattgtatatctagaaaaccccatcgtctcagtccaaaatctcgttaagctgataagcaacttcagcaaagtctcaggatacaaaatcaatgtacaaaaatcacaagcattcttatacaccaataacagacagagagccaaatcatgagtgaactcccattcacaattgcttcaaagagaataaaatacctaggaatccaacttacaagggttgtgaaggacctcttcaaggagaactacaaaccactgctcaacgaaataaaagaggacacaaacaaatagaagaacattccatgctcatggataggaagaatcaatatcgtgaaaatggccatactgcccaaggtaatttataaattcaatgccatccccatcaagctaccaatgactttcttcacagaattggaaaaattactttaaagttcatatggaaccaaaaaagagcctgcaccgccaagtcaatcctaagccaaaagaacaaagctggaggcatcacgctacctgacttcaaactatattacaaggctacagtaaccaaaacagcatggtactggtaccaaaacagagatatagaccaatggaacagaatagagcccatggaaataataacaaacatctacaaccatctgatctttgacaaacctgacaaaaacaagaaatgggaaaggattccctatttaataaatggtgctgggaaaactggctagccatatgcagaaagctgaaactggaccccttccttacaccttatacaaaaattaattcagaatggattaaagatttaaatgttagacctaaaaccatagaaaccctagatgaaaacctaggcaatacaattcaggacataggcatgggcaaggacttcatgtctaaaacaccaaaagcaatggcaacaaaagccaaaattgacaaatgggatctaattaaactaaagagcttctgcacagcgaaagaaactaccaacctacagtgaacaggcaacctacagaatgggagaaaatttttgcaatctactcatctgacaaagggctaatatccagaatccacaacgaactcaaacaaatttacaagaaaaaatcgaacaaccccatcaaaaagtgggcaaaggatatgaacagacacttctcaaaagaagacatttatgcagccaacagacatatgaaaaaatgctcatcatcactggccatcagagaaatgcaaatcaaaatcacaatgagataccatctcacaccagttagaatggcgatcattaaaaagtcaggaaacaataggtgctggagaggatgtggagaaataggaacacttttacactgttggtgggactgtaaactagttcaaccattgtggaagacagtgtggcgattcctcaaggatctagaactagaaatatcatttgacgcagccatccaattactgggtatatatccaaaggattataaatcatgctgttatacagacacatgcacacatatgtttattgtggcactattcacaatagcaaagacttggaaccgacccaaatgtccatcaatgatagacctgataaagaaaatgttgtacatatacaccatggaatactatgcagccataaaaaaggatgagttcatgtcctttgtagggacatggatgaagctggaaaccatcattctcagcaaactatcacaaggacagaaaaccaaacaccgcgtgttctcactcataggtgggaattgagcaatgacaactcttggccacaggaaggggaacatcacacaccggggcctctcatggggtgggggtggggggagggttagcatttggagacatacctaatgtaaatgatgagttaatgggtgcagcacacaccaacatggcacatgtacacatatgtaacaaacctgcacattgtgcacatgtaccctggaacttaaagtataataataaaaaaaaaataataaacaaatggtatccctgggaatcatatagataatatggtaaataaaatggaaaaatagaaaaaaaaagaaattgcctattttggacattttatatgaaaagagtcatataatatatggccttctgtgtctggcttcttccatctgacataacgttctcaaggtacatccatagtgtagcacatatcaatactttgttttctttccttccttccttccttccttccttccttccttccttccttccttccttccttcctttctttctttctttctttctttctttcctttctttcttttctttcggcagagtcttgccctctcacccagcctggagtgcagtggtgggatcttggctcactgcaagctccacctctgcctcctgggttcatgccattctcctgcctcagcctcttgtgtagctgggactacaggcacccgccaccacgcccggctaatttttttttgtatttttagtagagatggggtttcaccatgttagccaggatggtctcaatctcctgacctcatgatccacccacctcggcctcccaaagtgctgggattacaggtgtcagccacccgtgcctggccactttgttccttttcatggctgaatgatatttcattttatggttataccgcattttgtttattcatttgtcacctggattgtttccactttttggctgttacaaataattctgttataaaccttcttgtacaagttttggcataggtatatttttcatttctcttgagtgagaacctaggagtggaattactgggctatatggtaactccacataagttttagaattttactctgagtatacttatttcaataagtataaagaggagtgatataatctgacttgcactttaaaagataactcagactatggtgttgagaatatactgtaagataacaattttttaaaaagcggagcagcccagcatggcagctcacatctgtaatcccaacactttgggaggccgacacaggaggatcacttgagcccaggagtctgagaccagtctgggcaacatagacaaaccctctatgtctctacaaaaaaatacaaaaattagccaagtatgatgatatgtgcctgtagtcccagctatttgagaggctgagatggaaggatcacttgagtccaggaggttgaggttgaactgtgatgacaccacagcactccagcctcagtgacaaggcacgactgtgtttcgaaagacagagagaaggagagagagggagggagggagggagggaggaaggaaaggaaggaaggaaggaaggaaggaaggaaggaaggaaggagggagggaaggaaggaaaataacctagttaaaagtttgtacttggttgaatagcttccctccaaaattcatgtatacctggaaactgaatgtggcctcatttggaaataggttctttgcagatgtaatcagttaagatgaggtcataccgggttgaggtggaccctaatctaatgattggtttacttataagaaatgagacattttagctgggcatggtggctcacgtctgaaatcccagcactttaggaggccgagacgggtggatcacttgatgtcaggagttcgagacaggcctggccaatatggtgaaaccccatctctactagaaatacaaaaattagctgggcatggtggcaggcacttgtaatcctagctactccagaggctgagtcaggagaatcacttgaacccaggagatggaggttgcagtgagccgagatcatgccactgcactccagcctgggtgacagtgagaatccatctcaaaaaaaggaatgagacatctggacacaaacacaggaaaaaaaaaatccatgtgaaggtggacacatagattgaaatgttgcatctacaagccaagaaatccctgatgtcactgacactagatgtaccagatctagaaaagaagaacctacatcgctcctggatccttcgtagagagcaaggcactgctaacacctttattttggacttctatcctccagaactgtgaaagaaaaaaaaatctgttgctaaaagtcccccaacttgcagtactttgttacggcagcccgaggaaatgaatacggaggatattgttgttatttaggtgagaaatagagttggcccagactagtgtgatagaagtcaaggtgaagaaaaaaggtcagaatctagaattattttgaaagtagagctataagatttaccaaaggattgaatgtaggttttgagggaataataaaggaaccaagaataatccaagacttttaatctaaactattggaaagatgttgccataaactgaatgaggaaggctttgggtggagcagcactcaggggaaatacaaagagtccagttgttaacttttagaagcctatttaatacccaagtggagatgtcaggtaggcagttgtacataaaagtcttgaattctggagagaggtctcagctaaagatataaatttctgagtggtccacataacagaggcattttcagccattagatggcacaaggttgaaagagatcactaaggaatgcagagcagagacgaaagcaaggcctaccctgggtactgcaatgttagtaggtcaaggaaaagagaagaaatcagcaaaggagactagaagggagcaactggtgaggaaaaaggaagactaagaaattgtgatgcttgtcactaatcatcagggaaatgcaaattaaaccacaaagagttaccagcttactcctgcaggaatggccataattaaaaagtcaaaaagcaatagatgttggcatggatgtggtgcaaagggaacatctttacattgctagtgggaatgtaaattagtaccaccactatagaaagtaatatgcagattccttaaagaactaaaagtagaactaccattcaatccagtaatcccactactgagtatctacccaaaggaaaagaagtcatataaaaaagacacatgtacatgtatgtttatagcagcacaattagcaaatgcaagaatatggaaccaatctaagtgcccatcgaccgagttgataataaaaatatggtatatatgtatatgccatggaatactactgagctataaaaaggaacaataataatgtcttttgcggcaacttggatagagctggaggtcattattgtaagtgaagtaactcaggaatggaaaacccaatattgtatgttttcacttacaagtggaacttagctataaggatgcaaaggcataagagtgattaatgggccgggcgcggtggctccgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagcagagatcccgccactgcactccagcctgggcgacagaacgagactccgtctcaaaaaaaaaaaaaaaaaaaaaaaaagagtgattaatggactttgggggctcgatgggggaggtttggaggggttaagggataagagaatattgggtacagtataaactgcttgggtgacaggcacactaaaatttcagaaattagcactaaagaacttacccatttaaccaaaaaccatctgtacccccaaaaactattgaaattaaaaaaaaattgtgattgatgtggtttcgctgcatcctcgcccaaatctcatttgtattttagccccaataatccccacatgtcatggaagggacctggtggcaggtaattgaatcatggaggtgggtctttctcgtgctgttctcgtgatagtgaataaatctcacaagatctgatggttttataaaggggagttcccctgcacatgccctctttgcctgctgccaggtaagatgtgtctttgctcctctttgccttctgccatgattgtgaggcctcttcaaccatgtgaactgtgagtcaattaactcttccctttataaattacccagtcttgggggtgtctttattagcagcgtgagaacagactaataaaatgatacctgtactagaatccacttgaagaaagggaagcacaaattgatcaccaaggtgtgacataggaaagcatagtttgatggtccatcaaacactattgataggaaaaagtgagaactaagaattgagcattcaatttagcaatataaatattattgtgactaggatgaacaatagtttcagcagagtgtttaaagtaaaatcttggttagtgggtttgtagctgaaagagaggaaattggagacagcaattacagacacttgaaatttttatcagggaagatttcaagcatataaaaatatgaattaacaaaaaatgaaacccatcacccacattcaattgtttttaactgatagccaatgttgttcatctacttccccactccctctgtccctaccttaccagattattttgaagatactctgaaaaaataatttaacttcattcataaaaatttagacttctgctttaaggctcttgcattttttctttttctataaaaggagcaaaaaaacagatggtaatttgcaggtggaagtgaggttaagagaagatatttgtaaaccacttttggatccctgggttcagatgtggactagcaagagagttggatttaaccagggttttggttttgccatgtataaaacactgtgaggttcaagggtgtatgcaaaggaatgattactatcctttgataattgactatgtgaccataagcattttagctgggtaaggagtggagtgatgacataaagtgggtgaaatacactgacaaggtgatagaatcatagcttagaggtcaaggtggagtaataaagtggtggtggtcaaagagcacaagttagtcagagaagcgggtttacaggaaataagccagagaatgttcatcaacgtgtatattaacccatttcctgtttagaaaaaaaaagtgtggcttgctgccagcactcactgaattttacgtaaacacactctttgaggctgaagcaaatctgactgatttttcaatgtgaaaataaaatataaaaattcttcatggagttatttctaaacagaacttgtctctaatcctaatgtaacagaaatgtatatgatattacattaggattagagacaagagaacaagaatattcttggggcaaacaggaaatgggttaaggaattagactagagtagatttatagataaggagactaagctcaagagcgaaaatcatagagaaatgagttgaattacagaatgggagtggctggtgtcttttagaaaggagggagtatattctgaacatagcaatgaggatcaagaaaaaattagcccatgaccagagagagctgtgagagtataaataaacagtgcccacctaagaagactgtaagataagcaggagggagagctgtaattccattagagcaatgaaaagagattttccttggccactgcgtgacgcttttttaacatgtttttttccctcaaccataaacaattgcaggcacagttgtgagcatgggcaaattcaggttttatgtgacctgaaacttacttagtttggaggactttctttaaggaaagactgtaaaatttttattttcccagattttaccaacaaaaaagtgcaattatgcaaacccattatccacttaccttccaatagcccactcgaaaggggctattgggaaacaattctctatggatattttcacctttctgcatgatccaggctttctgagcaaacaatatggtcaaacttgattaaataattattaagtggtaaacatgccttggaagccagaaattgtgtattaatctggaaatatttatcccttggataaatcccacttgatcatgctaaatgatctttttaatgtgttgttgaatttggtttgctagcattttgttgaggatttttacaactatgttcaccagaaatattggcctaacactctttttttctgtgtctttgtccaattttggtatcaaggtaatgctgaccttgtagaaagagtttggaagtattaccacttctcccattttttttggaagagtttgagttttttctttaaaagtttgacagaattaagcattgatgcaatcaggtcctaggcttttctttaatgggagactttttattacagctttgatctcattacttgtttgttcaagttatttttttctttatgattcaatcttagtaagttgtatgtgttcagtaatttatcaatgtcttttagattttccaaaagaaacttgtggtttcttttggaaaaagttgtccataattgtttttaatgattctttgtatttctgtggtctcatttgttaactctccctttttgtttctgattttatttacatgggtcttttctcttttgttcttagtttaggtaaaggtttgttaatttattttttcaaaaaaacctttttgttgatattttgtattttttactctcaatttcatttacttctgctctgatctttattatttctttctttctactaaatttggttttgttttgttctcttttctagctccctgaggtgcatcattaggttgttaatttgaagttcaaagataatatagaaatacagtggtcattgtaagaaagttttaacctagacaaaactgttcatttatgaagtggattggaaaagaagaaattctgaattcctcaagaacaatggaatgtagattttgattatcatgcagagccttacaagagactcaataaatcaaaatatgcctctcttaaagacttctggccagaagcagtggctcacacctgtaatcctagcactttgtgaggctgaagagggcagatggcttgagctcaggagtttgagaccagcctggacaacatagggaaacctcatctctattaaaaataaacataataataacaattagccaggcatggtggcacaagcctgcagtcccaactactcaggaggctgaggtgggagtgttggagtaggtagttaggcagacatgaacatcagaagaaaagcccatcccccaccagtaatgtcaggcaaccattaggtgatggtcaggtagttgttaagcagtctttttaaaataataattggttgcagtcagtgccagagaaaggcagtctcccaatatatggaaaacacttgaagccggtggccaacagcttcccaataaggagctgagcaagcagtctcaagcatgcactaagaggcaaaatggcagagtttaactggtgtatgaccagttcctctaggaacacttgactggcaagggaaaaacgcctcaagtgagcatgcacacaacttcagtaaatacactgtgcatgtggccgctcacaagtgctggcaggccactgtgcatgtggatggcccaccccaaggaaaaatcaagagtggagagacacaaaactccagaagcatgccaacatataaaaccccaagtcaaaggtcaaacagggcacttggatttctcaggttgccaacttggccctcttccaagttactttactttctttcattcctgctctaagagtttttaataaactcttacttctgctcaaaaacttgccttggtctctcactctcgcttatgcccctcagacaaattctttcctttgaagaggcaagaaacaagttcttgcagacccatacagattcactgctgctaacatactttgatgccacatggcttggatacgttccccagtggtaagaaatctctatgcctctccttctttggctggagaagaaggagatctgtacacagttttcttctcccctttcactctcctgccttccaaccaattcccagaactattactctcagccacagtggctctgcacccgctggctgatctctcagcttaccctgaccggtggcttacaggggtaggaaggaccttggagtccacaccatgtagacctgaaatactaatggccctcctagacaggaggctcatgagagtggtagggctaaagcctaacactgtgcaatgtctgcaatttcctctgctttttcaaatacaattgtctttttccccaaaacccacaccacctattctcctgttttctctgtgtgtgttctgaaacggccttgtgtgcccaccacactgtctacctcaggggcaagtctgtctctcttctttcactttgtatgccacgcaacttccttctctacgttaaacacacactccctgttattcgttcacccatggctcttgttgcatttgtacagcagcagagaaacaggctcccttgcagatgtccattggctcattgccaggatagacactaattagaaccccagttcttccagctccttatgacttaccatacacttttcatccctgttatgctccagggtcaagtttttggtggcttttgaagcagtttttatggctgcataggacatcactctgtggttctttaaggatctcacctacttgctttttttgagttagcaccccctttgggaggagagaaaattcttcctttgccatttgtgggctcttatcccaagctccgagttctccaaagattcctctttatgtcaagagggcaaataaacattgctgttttgaatcccagggctgctgtttatgtgagcatatgaaggttttccgtcagtattcctcatgcttcctcccactttctcctatagcagaggggttgtcctgtctactcaagcatttcttctggatattaccccaggaggacagggaacctctaatacaaaattttctccattcctctaatcacttccataccctcctcaatgtgcttaaggactctcaaggtcatatttaaagggagggaagtgcagcctcttgcagcagttggctgaaaaacaagcttctcatctacttaaagaacatgggaaatggattataaaaaaaaaagaggtaatcattttgttgccagaatgctgtgagtaagagtcactataagatcatggagataaggatataggccagcccaaggctgcaggtgcaagagacaaagtacccataggacagagagagataaaggctggtcacaggccacaggcacagaacagattaccattagaacagagatgaaggcaagcttaggggtacctggtaagaccggtttattctgaaactccaaggataaataggggacccctgttcacttgggtatttcctctgttctcaagtgggtaattgtgatgagatgggacacaggtttgggtacccagtaagacaggttcattctggaaccctaaggatgaatgggggatgccctgttcaggaaaggataatagggaaataaaaggagataccttctttttcctttttttctcctttgttgtatcttcacagatgggtaatcacatctccctactacagtacaaaccctttggatgcatcctcaagaactgaaagtttgaccccaaaaccctgaaaaggaaaaggctaatatttttctgtatcacagcctggttttaatacaagctccaggagcaggaatcttgaccagaaagtggaagcataaattttaaatttttaatatgctctatcagctagatctgttttgccactagcagggaaaatagacagaaatcccctatgtacaggccctaagaaacaacccagacctttgttgggcttgtaaaattgatccagtgatgatagcagccataatcatgctgccccatctggttggttcgggagacccctcattgggtttacccagggctcaagccctggaggaaccaagagtggagcttagctcaaaccctaccctttggccccattatatccaagtctcctggccctggagccttcccttccctacccagggccatcctctggacaccaccccctcaagttatgctcccttcaagaagttagttgacctactagagttcagactccatttaatatgcaagacctgagtcaaattaaaacagaactagggaagtttatggaggatcctgacaaatgcatcaaagggttccataaactgggcttaacatttgaactcacttggagggatctctcagtcatactgggacaaaccctgtctaagggagaacatgactccattatggaggcaccccaaaaatttgcaaatgcaatacacatgactgaccttggtggctaccctgtatgggccaccacagttcactgggtcagccccaattgggattacaatacccatgggggcatatgggcaaagaattgcatgttcttatgtctcgtagaaggaatgaaagctagaagagccaagcctgtaaactataataaaattggtcttaatagatcaaggacctcttggaaaccccaccactttcctagagaggctacaagaggccctggtgaaacacactaacctagacccagagacatcacaagggcaactggtcctgaaggaccattttttaactcaggcagccccacatatttggaggaaactctaaaaactagcactggaccccaaaacccttatgcctgacatcttcaacatagcttcctctgtcttttacaaccaggactaggagaaagaggaaagggctcagggaaagaagaggtaaaaggaaaagcagcagctccaactattggctgccctaaaaatccaccagccctctccaagttgccctcagaatactctcccagttaactgccatcagtgtgggaagccaagacactggaagacaaactgccgcagtgggacagatgggaaaaatccctacatggcttgccctttctgtcacaaactcaaccactggaaatggaactgccctgagggctgaagggcccctagaacagaatcccaattcctgatggccttaagctgaaaaggcccgccactccagcagctcctggactgaacattactattgaagggacagagctaagggctgctttggatgtggcaggtaggactataagttttctttgggaaatggccttcttggtgcttatgtcttcatgggcaattatcctccaaggtgatggggttaaattgggtgcccataacccaaaggttcactcctcatctttgctgcctgtgaggggagactgtcttttctcattcatttttaatgatagcagaatgtcctacactgcttttgggtagagatattttatttagactaggggcttagttaaccttttccaaatgcaatcttatgcctcaaggaagtcacacacaaggatgaacttcccagacttttccattaatccagaagtctggggctcaagaatatcaggaaaggtcataatgataatgcctatagtaactcagctcatggatccttctagctaaccttgtagaaggcagcttcctctttgacctctggccaaaagggacttcatcccctaattgaaaaatgtctaaaacatggattattaatatactataactcgctatgtaacacccctgtcttacctgttaaaaagagcaatggagcaatggacaatataggctagtccaggacctgcaaatcataaatgaggcagtagtcccaatacacccaatggtccccaacccatatattattctaggagaagtacccccagatgctcatttgttctcagtcttagagctcaaagatgctttcttttgtgtctccctagactcatcctcccaatttgtatttgcacttgaattggggaatgaaaaaggaaggagtctacagctaatctggatagtacttccgcaaggttccagagatggttccaatttgtttgggcaagtcttggctagagatttgcaggacctaactcttgagggttgagggtgtctcctacagtacatagatgacagatgacctgttaatctgctcccctacaagagagttatgaatcctgcatctagtccagacactagattttctcacagagggtacaagatgtctaaggccaaggcacatcgattaagaaaagaggtttaatacctggggataatcctgatcccacagagaacataagctttctccagaatggatacaggccatccttagaatacctaccccaaccacctaaaagcaactttgggcttttctggggatcacaagatattccagactttcaatactggcatatggtggaattattaagtccttatatcaggttctaaaagaagggactcatcaggacccacttctctgggaaaaagatcagaagcaagcctttagagaactaaaaactgccttctcacaagccctagcccttgggctacccatactaaccaaaccgtttcagcttttcatcactgaaagtaagctgtagccctggaagttctaactcaaaccatcaggccatcaaatgtcctataggttactttttaaagaacctagacccagtagtgcaagggtggccacactgcctaaaggtagtggctgcagcagcccttttacccaaggaggccctcaaaatcacaatgggacagtcggtcaggctcctgacattccaactaataggccccttattggatataaaaagaccgcaatggatcactgacaacagactgctaaactaccaagtcttgttgtcagaaaacccacaggtaacagttgagtggtgttccactcttaacccagcctccttactgccactactagaagaggataactgaacacattcatgttgtgagatacttaaccaaatttatgccagccaggaagacttacaatatcagcccctaggttatctagatgaaatatggttttcagataggattggctttgtcaagaatggagatagatatgcagggtatgctatatgtcccttcacccagttacagaggtggtagctctgtccctggggacctcagtgcaactagctgacccatcacattgaccagggccctaaaacttggggaaagaaaaagaataaccacatatacagattccaaatatgccttcctggtgcttcacacccacatggctaaccagaaggaagggggatacctaacagcttggaatactcctattacatagagacctccaatcttagagctactagaggctgttcatttgcctcaggaagtggcagcagtgcactgtaaagaataccacaggggttctgatgaaactgcatggggaaatatgttatctgaccaaaaagctaaagaggcagccatctcaaaagacacctctgtggggactttactcccctctctccccagtgaactgcccttctccaatacactaaggaagaaatagattgggccatccagcatgggtataaagaagaaaccaatggatggtacatgttgggagaacttctccatctacctaatgcttcccagtggaaagtcatcaagtgtttacttgactcatgccaccttgaaaaggacagtctagggtaaatttgtaaatgggtgttcagtgggaagggactaaccaaaattattcaataggtttgtcaagcctgcaccttgtgaaccacaaataatccctagatggggaagccccctccataataagtcaaatccaaaggagaggtacatactctggggaggactggtagatggacttcactcagctacccacatgccacaggtgtaagtacctcttggtctgtgtaggtaccttcacagaacgggaagactcctgccccacaaggactgaaaaggcacaggagatagctgacttgctcctaaaggaactcattccctgctttgaactccccaggtcattgcagagtgacagtgattcatctttttttccccaagtaacttaacaggttagtaatgccctaggcatgaagtggtaccctcactttgcctgagaactgcaatcttcaggaaaagtggaaagaatttaccaaaccctgaaatgcatcctcaataatctctgtcaggaaatagcagtcatgggtggacctcttacctttaaccctccttcaaatctgtattgcccctaaggctccctagcaattaagcccctttgagatcttatattgtaggccatttctatattcagacttatctgatactagatgaagaaactgccaaaatcacccagtatgtttcttctttagcaggcttccaacagactctctgggaatatgggttaaaaacaaacccaacgtcggaaggggaaacaatcccagcctctgtatcttccaggctctagttctcattaaagcttggaaggttgaaaccccaaattcctaactaactgtattctgggggggccacttcactgctccagtatctattcccacagccattaaagtaccagagatagccagctggatacatcatgcctgggtgaagtcatggaaaggccatgcaacaccagagccagaaccaacaccctcagctccagaatacacttgtgaggcactggaagacctgaaattcctcttttagtgaaaacataagtaatgccccctcaacatcctttcacctcaaagtaaggtgatcctagtattaggaattttactaacaattgttatgattattatcactattttaatcccaacttgtacaccaccaggagttccagtggcagcttgctttgtgatcaatttctctctctcacaatcaccttaggtcaccatggctctgctcctgttggttctcatactcaacgctttactggcagcacactgccatcctgatttcctgttatgagaaaaagctcagcaattgctccaaaacacaggatccccttactccaccaaatgctggttatgtactagctcttcctctaaaacaccagggagagcttatccagcctgtaccagagattggacaagcatagacatagagttacgtatttcctctcaacaggaccctaatctgaaagagctatttgggtctgcaaataacattttttgcaaaagcaaagcagtatttacttgacatccacaaggcacctctcatttttggatcaatcttttctaatatcactttaatgggaataacctctatttgtcttatggccaaaagaaaaagatggattggatgtaggctctttcccagtatagcttgtaatgttactctctctgtagattctaaccaacagactgatggaacatacaccgaaaaccaattccaccatcaaccaagattccccaaaccttcaaatattatctttcttcaggcaactttgctaattaagtccattcagttttgccagcaatgcccaagctcatgcagtacttgaaatttctagttccagcctgatgattataaccaatgtctgcaaattgccaacctcagctccacagcagaatgggttctaatggagtaaactcaaaattctctttttttgggaaaatgaaaccaagggagctaatcagagccaaaccccatgtacccaagtgttagcaggcatgaatgtagctaccagctacctgggtgtgttgtcatccttggtatttttgggggctgtcctcatctcttcttttgttttgacatctctacttgtcttaaaacccaaggagccttctgtgtttgtggccaatcagtttaccaatgcctcctcattaaatggactggaacttgtaccatagattatgtacccctggacatctttatactccctggcaatctctctcttccagcaccaatccatgggaattctatcttgcccagggtgaaaagggctatccaattaattccccttcttatgggcctcagcattatagctggtatgggaacctaaactgccggaatctcaaaagcctccttgacctatagccaactctgaaaggaaatagccagcaagtttaatatcatggctaaaacctcaaccatggccagagcaaattaacactttagcagttgtagtcctccaaaactgtcaaggactagatatgttaatggcagcacagggaggaatttgtttagctttagatgaaaaatgttgcttttgggtaaatcaatcagtaaaagtacaaaacaacatcagacaactcctaaatcgagcctccagcttacaagaacaagcctctcgtggttagttagattggtaaggaacctggaaatgggatcttccctgggttcttccctttttaggcccacatgttagcctctacttttgctcctttcagtccatgtcttcaaaaatctaataacccaatttgtctcctttctctcacctttagatgatcaagttccagatgatcctcagtgagggataccatcctttcaatattcaagagtcacccttctacagaggactcctagacttcccatcagtgggacatggcagaggtgaaatcctgcccctgtctcccttagacctggctggatactgcttccaacaacccatgcagccaccctgccctgacagctagcaagaggccaagacccacagaacaatcaccatcacacctctgtcagcaggaagcagttacagaagactgaccttcatccagtttcccaaagaattgggtcatggatttttgcgggggaaaatgttagagtaggtaattaggcagacatgagtaagggaggagagaccccctccaactaggaatgtcaggtgagcatcagatgatcatcaggtggttgttaaactctctctctaaaataataataggttgcaactggcagcagggaaagacaatctcccaatagatagaaaagtcctgaagctggtgatcagcagcttcctagtaagatctcaggatttgggcaagcaggctcaaacatgggcactaagaggcaaaatcgtggagtttaactggtatacagacttcctctaaaaacacatgactcatgcacatgtggacagcctgccccaaggaaaaatcaaaagaggagagatgcaaaaccccagaagcatgccaatatataaaaccccaagtctaaggtcaaacagggcacttggatttctcaagttgcccacttggccctcttctaagtgtactttatttcctttcattcctgctctaaaactttttaaatttcactcctgctcaaaaacttgcctcagtctttcactctgccttatgccccttggaagaattatttccttcaagatggcaaaaagcaagctgctgcagacccatacagatttgctgctgctaacaggaggataacttgagcccagaaggttaaggctgcggtgagccttgattatgccactgctctccagcctggcaacagaatgagactctatttttttttcttttaaaaagactttttacaaaaggcaaaatgataatggaactaaaaatgtacgttgactgacttaactccaactgcttcttccctcaattgaaaccacctttgcaaaaattataacagtgagaaaattatggcagtaggggtgatctgatcaagccaaaccccatcttgcctttagccttcaagctgcccataattattcctgggcttaggccaagctaactttgggagacacttggtctatagtttaaatgataatagtccttccttaaaattcaaccacctcagcaaagctgatgagaggccaccaggcaaggaggatagaggagtctaaattctgctaaggtgtagatataaacagtttccagccattattctggaggtcacaaaatgtgcaacttcttcaattactcctgcagataacatcagtattttagaacctaagattggccttttgagatgtcttttcaggtttttttgtgtgtctgactaccgatggctccacctggacccaccaaccactcctgtggccccatccagaagcaactcagcatgcataaggactatttcccacacccctatgattgcacccccaaccaattagcagcaaggacttattgcctaaaacagccccattcatcccccaaaccatccatgaaaaaccctagctttcaaatttccggggaagctgatttgagcaataataaaatacgtctcccatttagccaactctacatgtataaaactctttctctattgcaattcccctgccttgataaatgataaatcagctctatctgggcagcaggcaagaagaacccgttgagtccttacaatatccttctttctaccctcctctgcctaattactctgaatctactaactttttcactcagttatttttccactttgaagacaaaaagttagaaaaaaaaatgccttatgaaattagtccctcagaataaaccagctgggctttctttagccacctgtatgctttagtcaaaatctaagctcagaggcaatagtgaaaggctttcttatcccaaaggaaaactctcagaaatttgctgaagctatccacactgagtgtaggtatagaacatgctttgccctatttattcatgggcaccatcctgaactcagtaatctagcttttttcttttgaagctggatggggaagacacagatctagctgaattagttgccaaaatatgctatctggcataaagattattttgagagagttattttgagactctttgtaagagaaatttatatctacaaaggaagtctccatttataagcttgtctctctgcatcaggaagaaaagaaggactaaatcaccagacactcttaaccaatggagaaggagtttaagtaacaaaccttacctttgtttaaggtgctttttctggctctctgccattaagatctacattttccaccctgtctcctctaggacctgagggttatctctttgatatgcaaatgccagggagattactcaccagaagaagaagaagaaatagagctaattggaaattgagcaaataaaaaaatcttgttttttctcccagaaacagtgaaaagctttagccatcctttagataatcttaacttgttccatctgccagaaacacaatttggattcagaaattctttatgaactgtttttgtattattgtacctggcacatggctacagttttcaaatgaaaactgtgaaatctgcttctgtctgtattttatgtatgtctgtgtatgcatgtatgtgtaatatttttctacctctagagactatcctaaaattaacttataaagagctgtatttaattgccttaaagaaaaagcacttatacaaattaagtattttttaaactttcagaaaaataagacctagcgcaaatgttcttcaagttgatattgttaaaagaagaaacttcagccaaattaaacttaaagaagtttaattgagcaatgaatgattcacaaatcaggcagcctccagagttacagctgattcatggagactccagggatgcctcatggtcagaacaaatttatagacaaaaaaagggaagtgacatacagaaattagaagtgaagtacagaaagagctggactggttacaggttggtgtttgccttatttgaacacagtttgaacactcagcagtgtctaagtggttgaagtatggctactagaattggccaagactcggctattgttacaggaacgtactcctaaattaggttttcaatcttgtctacctgttaagttaggttacagttcatccacaaggactcaaatatagaagtacggagtccttctcaggctatcttcagttctctttaacagtatgatacgggataatcttcagtaaataaaaatttctttaagtttgttggattaactaaagcaggcatgtcttcagagttgtcaacattaaatataatacatacatacagtttttttctaccaggggttactaggcaaataagtttgttattgtaactagatgtttaagattataaaactgtcagtttaatctaagagcaaaagtgaaaatgtggtagctattttattaagtacagcggtaaagcaagtatatattaagtatagcagtaaagcaaaaaaacaaaaaaaaacaagtatttaacttttttttggtttttttttttgagacggagtctctctctgttgcccaggctggaatgcagtggcacaatctcagctcactgcaacctccacctcccgggttcaagcgattctcctacctcagcctcctgagtagctgggattacaggcgtgcaccaccatgcccggctaatttttgtatttttagtagagatggtgtttcaccatgttggtcaggctggtctcgagctcctgacctcatgatctgctcgcctcggcctcccaaagtgctgggattacaggcatgagccaccaagcccggccttaacttttttttaggttcttgcttttgtgatatttggctaacatacatatgctgtaaaaattgttaataggaaaatattaataatgagatgttgactagctttgtctgtctaatgaaatttcataagtcaattaaaattaagaacaattgaattatagaatagaattcaattgaattctattgaatacacttgctgaatacaacaattgaattgtaaatagaatagaaattataaatgaacttttcaatagtaattattttttaatacgggtacttaaaattgtgtcaacttcttaacaaaagaaatggaggcaaaattagtataaacagtttatttgggccaaatttgagaactgcaatgtgggagacacgtcttcaagttgctatgaatataaactccaattagcagcagttacaagcggttttttttttttaaagaaggggcagttctttagttgcatataaactattgattggctatacatttttttttaaccataaattccaggagcatgaacataatgggtgagggtcacatcccctgggcatggatttggggcaggatgtgacaaaaatctcatactcatgtctctctgggcctgataaattttgcatactttatatagttcagactcttctgagctacgtttctttctcttccttttggttgagtttttttttcttctgaaagtattgatgatcaacattttagatgtaagtttgtcccatgtcactggaagacttagttttagttagtctcatcccacattggaggaagagaggagagataaaatggcttaagaatgcagtgaagtctcaaggccaagttgattggcaacacaaagggacagggcaatggtatttcaggtcatctgcttacaaaggagctatggcatgttggatcatttctaagcatctagctatcattattttagtgtttttgttgattttggacatctagaagtgcaaagtataatcaatttgagaataaaagacatgatgcaaataaagacaattactaacaaaagccagatctgaaaaatgtttttatttccgaaggcgaccaaataaatatgttttctacttcttgtgctgatctaaagatcaatgtataggagatctccagtgatgagtttgtccactcaggcagagctgcctttttaaaataaaaattatgaatgcataagtcaatgtatttgaatttaactccacaagtattggttaacaatacagatatggtcgcttccaaggtgtttggagggagttttgtatttgatggcattccacattggaggccatgctatttgatgtcttcatctcctggaaccacactgtattgtttggacatatctatccagacagatgatgataaattttgcatatctcacatagttcagactgctctgggctacttttctttctcaatagcttctcattgttaacttatgcctgtagagttttgctaaactaaattagataatggacatttattaaatatttagatcatttccaaataacataaaatgctgaaacattaattgcttaacataagttaatctacttttggtttttattacaaaggaactaaatatatttacatctgttaaaaaacactttaaactgtactatgagaaagaatatacttctatagaaattataaaatggtatatttatagatttaccattttatggaataccccataaccgttcacaatttcttatttcctagttttcactagaaattgaagttactaagagttaacaattttaactaatatagagtagttaaaaagactaaaaataataagggagataactatatgcaaagaaagtaagacatgtttttggtaaggaaagccataaggtataaggatgtgcttttttttaaggaaaaggaagaataatttggtctagtttggaggttatttaaaggttgtttcagaatgaatgaaagataaaatctaaatggatacaaaaaggaagagagatgacacacacacaaaatgaatgactcttgtatggacaagttggctagaactgaatgtattataaggttttaaaaatgagtcttgaccaagcactgtggctcacgcctgtaatcccagcactttgggaggccaaggcgggcagatcatgaggtcaagagatcaagaccatggtgaaactccatctctactaaaaatacaaaaattagctgggcgtggtggtgcgcacctgtagtcccagctactagggaggctgaggcaggagaatcgcatgaacccaggaggcagaggttgcagtgaactgagatcacaccactgcactccagcctggcgacacagtgagactccatctcaaaaaaaaaaagagtcttaatatcaaaagtaaactgatgcaaaactagaatttggtcttctctgtgaaaatgacagttttctttttaaagagtattgctccagtttttaaaagtgattgtgaaaaattttcctttcccttgtaactaatcggcctacaaaatgaagattttgtgttttctcaaaataattctttgtgcttcgtgttgcctttttttggtctttaattacttaagaaaattgaatcttcccaacaaaagagctagttttgtttgttttgtttttacagttattaaactttctctatttgcctttgaaacctcttagttgttactttttgtgtcttcacagtgacttttgatatatttaatcaagtgtttaaaacatttgatatttttgccagacttcctaaaaccaaattctaaactaaatcttttttttaacctcaagctaagtaggattttccagatggattcctggaatatctcaaaagactttgttttctttccttatagaaagagaggtcaggcacagtggctcaggcctgtaattctagcactttgggaggccaaggtaggcagatcacttgagcctgggagtttgagaccagcgtgagtaacatagggagacccttctctacaaaaattagcctggcagcccagcgtggtggctcatgcctgtaatcctagcactttgagaggctaaggtgggctgattgcctgagctcaggagtttgagaccagtctgggcagcaaggtgaaaccccatctctactaaaaatacaaaaaattatctgggcatggcggcgtgtgcctgtagttccagttacttgggaggctgaggcaggaggattgcttgaatccgggaggcagaggttgcagtgagccaagatcacaccactgcactccagcctcggcaacagagcgagagtccttctcaaaaaaaaaaaaaaaaattagcctaacatggtgtcatgcctgtagtcccagctacttgggaggctgaggtgggaggatcacctgaacctaaggaggttcaggctgcagtgagccatgattatgctactgtattccagcctgggcaagaaagtgagaccttggaaaaaaaaagaaagaaagaaagggaaaaagaaagaaagaaagaaaaaaagagaattgcataggaagttgtcaaataagggtgatgtttaaccttcttatgttataatattattcatgtaagttttccagatgttctgtgaacttctacaactccgatatgtcctgatatgttatcagtcataattttagttaccttaaaatgttgtgtttctcagaaataacaaattacattgtcaattgcattataatgaactttcatcagatctttaaccatggccatttttaagtctgttgtcatccacaaacagtagttttactctgatactttcctgaaagttattccaaatgctttgtttgcaggaagatttatggaaaatattgaaatgtgtgggtttctggtaactttaagatcataacattggactgcataagaatttccaggactctattggaaaaactaaatttataaaattgctaacccaagatcaagtagaagaaaaattaattacatggtgatatggtttggctgtgtccctactgaaatctcaacttgaattgtatctcccagaattcccacatgttgtgggagggacccagggagaggttattgaatcatggagtctggtctttcccatgctattctcgtgatagtgaataggtctcatgagatctgatgggttaatcaggggtttctgcttttgcttcttcctcatttcaccatcaggtaagaagtgcctttcagctcccgccataattctgaggcctccccagccacgtggaactgtaagtccaattaaacctctttttcttcccagtctctggtatgtctttatcagcagtgtgaaaacggactaatgcacatgggataaaatgtattgataataatgataattttatgacttttcgtttgaaacattgctgtttctttaatgtctaatttttcagatttaacgtaactttttctttctttccttaagctatctatagcttacagaaatttagcagattatacctttatcaacagaaaagaagcatatactttctctcttacctgatccctccagaattcagaaactattagcaagtattattatttccaaggcaatatagttatatgcataactgcaataagaatatgttcttctgggctgggcgcagtatctcatgcctgtaatcccagcactttgggaggccaaggagggctgatcacttgaggccaagagtttgagaccagcatggccaacatggtgaaaccccagctctatgaaaaaataataataataataataatacaaaaattaactaggtatggtggtgcacgcttgtaatcccagctactcaggtggctgaggcacaagaattgcttgaacctgggaggtggaggctgaagtgatctgagattgtgccactgcactctagcctgggtgacagagtgagactctgtctcaaaaaaaaaagaatatattcttcctataacaggacacaattagaaacactggttatattaccaaggttttaaatagaatatcatacttaaaaatatgtgtaaaattttatatgaccagccgggtgtggtggctcacgcctgtaatcccagcactttgggaggccgaggcaggtggatcacctgaggtcgggagtttgaaaccaagcctggccaacaggacccttaaggacccttaaggagattttaagaacctaatgaagaagagaattcacccaaaattataggcattgcagatgaagtctgatgacaagtccttggcttgccttcctagcttggaaagactttttaaattctaatttgagactccttattaaaagtcccagcaaagtatactttgaaaaagcttatgtaatgaatcactattcttactatacttatgtaagtaatcaggccaagtgtaacgggactaggcctattttgcaaacaaatcagttttactgtgattatttttggaatgggcatgactataaagagaaaaactatatattagtagaaaactatagcacacccattgttagattctagcctagttcactgtctttgaggttttgttatctacttgtaaactgaactggatcctgaattctaatttcctccagtatctggctatgacttctaccgagctgactacaaatttgagggttcccttgacctcttcctcatgttcaataatttactaggacaattaacgggaactcaggaaaacacatatgattgccagtttataatgaaaaatacaatttaggaatagccaagtggaagagattcatggggcaaggtatgggggctctttcttccatgccttctccaggtgcaccatcatcctagcacctcattgtgttcaccaacccagaagctctctgaaccccaaagtttagaggttagtatggaggttttattacataggtatgattagttaaattgccaaccattggtgcttgaacattatctttactgcctttcttcccccaacccccagaagtggaaaggggtgctaaaagttacaaccctcttatatttgctttcaggtgacaactttcaaagtgagttggagcaaagaccaaacatatatttgcatgaaatcatgacatcctatagtaatatttgattttcaaactctgcatgtataatagttacttaaaatttaaattaaattttaaaatgtaccagttatgcagctgaattttggtactttttcccttggctttgtctggtatctgaatccaccatcatttccctgtacaatatctgccattggagatccaattgggaaaatacatttaaagaaaaaatctaagaagcatctcataggttgtggttcccttgcatccacactcattatcatggtattatcttccccaaggtgggtaatagtatatccctggctaatatcaagattagcactagctgtctgtagataccatttagaaaagttttctctacatgtcctctctcaccactcctattcaacatagtattggaagttaaaaaaaaagttttctctacttgaaactaaaatttatggcagactatatgcttccgaatgttctaaaaccttactagaagacaaacattgtcaaaggtaggaatgtggccaacatgtcaggtaacgcctataacaaattaaaatctggcgattgctgccaagatacccacaaaactatcggaggcaactgctgctaaaagaccataaagatgattctggagacaaaggcctgtggaagtcaataaaataatggtcaaagtggacaagatttaaaaaaattaggattcagaaagaagccaattgtcatttaggaaacaattatctgataacaaagctcagtgccctcttagggctgacattcatgtacatattaaatattgtagaactgataaggcttggtggattatatttgacaaaggttatttgtatttcaaaaaggaatcaacttttgagacaaaggaatgctttaattcattcaacaaatatttgccaagtacctactttagggatatgatggtgtgtaaaaaaatttttgctgctatcatggagtttagaatatagaggtaaggccaatattaatctagcaacattaaatcttgtgtaattgtaaactgaggtagataagtgctcaagaaaaaaaggttctgtaaaagtttatatcaaaagatcctgatcaaagaagtattctaggggaaataatcattaaactgagagctgaaggaagagttgggttgaatggcataaatcttaaaatgagacagggtttatacctgagggttggtatattagtttactaggggtgtataacaaagtatcacaaactgggtagtttaaataacagaaatgtattgcctctaagctctggaggctaaatatctgagatcaaggtgctggtaaggctgtttccttctgggttgatgagggagattctttttcatgactctctcctagattctagtgatttgctggaaatctggtgtttcttgacttgtacacctttgcctttgttatagactgatgttgtctccccctaaaacttatgtgttaaaatcctaacccccagtgtgatgggattaggaggtggctcttctttggggaaataattaggtaatgagtgtgcaaccctcatcaatggaattagtacccttagaaaaatgactccagaaagctctctcatcccttctgctatgtggggacacagtgacaagggggccatctgtaaagcagaaagcaggccctcaccagacactaattctgccagtgccttgatctgggacttcccagcctccagaaccatgataaataaatttctgttgtttaagccactagcttatggtatttttgttgttagtccaaacagactgagatagccttcatctccacatggcatttttttctctgtgtctttgtgaataaatttcttctttttataaggacaccactcatatttgattaggagtctaccctaatccagtataagcttatcttaatgaattatgcctgcaatgactctatttccaaactaagtcacattttgaggtattgcagttaggacctcaacatatgtatttttgggggagacacaatacaactcttaccagttgagaaagagacaatgggagcaaagaagatttgaaatttacctgctgacttagctaggttaatcatgagagaacaaaaagctttcatttgaaaacgcttcaggaaattcagtgttctcaaaggagagttggattgtgtttataccaagaagggggctgaaactatctgaggaggaggttcaggctataaagattatacagattgattattgagaaaagtacaaaggagcacagtgcaaagtttgggaggtggagaagtttgagtcaaaaataaggaagtatagagagcattattgggatgatgggaaggtaaaataaactggccaggattaattgcttctattcatatctctgcctgatgaaaatgggagtgagaagtgtgatggctttagtctcaaatgccttcttgagaaaggccaaagaatttagactgcccagtccagaacaatgtcagtcccaataggtatagtctctgttctcctggccagaactagaatcaattactggctccatcattcactagatgtgtgcgtttgggccagttacagtacctctctaagaccgagctttctcattcttaaaatgagtataataataacacttagttgaggaagcttgtgtagtacgtctcagtatcactattgaagggctggaggattctcatgccctcgataaactgtgtgatctctcagatcctctattttctgattttaaaactgtcatagtaatgctttagagtactgtaataacaacttatggagatcttatttataaaaagtaatttgagaaatagaaaagtaacacctagttacttttttcctagttattttgggccaggattgtgttctgtgactgtgtctaaatgcaccatgagaggacgcccagggaaggcacctccactccattctatctcattcctctttcctagtgtgagttcatcctgtgtgctgatttattttccttaatccacctggtcctatcaaagggccatttcagttagttgctccacttcagtttatgggagataagtcttgtccagattttcctaatggccaaaaaagtcaaatccttatcctctttgggctttactcaaaaatgcttgttcagttagggctctagttttattccccagagattctgcatgttttatactgatcttgccagggccttcatcttttgggctagtctctggaaaatctacctctggtcctgtgcacttttccccctctagattctagaaggaaaagcaatgaatagcgtctcccacaaagatatttccaagacctaacccccagtacctgtgaatagtgagagtaaaatgattagtggctgccagaggttcaagagaaggagagaaatattgaataggtgaaggacaggggattttttagagcagtgaagttattctgtatactgtaattgtgtatgcatgacatgttttttcataacccattggactttacaatacaaagaatgaacttaaggtatgcaaaatttaaaaatcacttaggagggggcagggccaaggtggtagattagaagcagctcatgtgtgctgctctcatagagaggaaacaaaagggctagtgaacattgaccctccaggctgatcatctgaaaaaccatgctgggatccatcaaggcagtgggtgaacacagagtacagagatgagcaaagttgggcaccagcctttcaggactcagagtgaagccaagagaacctctccaacatgggaaagggtgagtgagtgagagcccccagaggaattcacactctgcacagggacccacacaagacttggaatgggagaatccccctggaccccctggacacctgccaccaccatgctcctagactgaggcagagagccaactagatgttttgcaggggcaactcttgagtccaaggggacctctacaagccttggccccttgagtagaccagcactggttccacagccccaaaagaggccacagttgcagtgcctgggagaagtaagattgccccgccccctcttgctggacagggcttgatggcagcttctggcccagcagtcccacttcagcctgaacttgtctggccactccaatcacccctcaccactggtatcctggcgggcaaccctcgatagagcttccagcccagtagtcccacttctgtgtcaacttagcccatggacacagcctcctgttgtcccaggaagcactcagacattagggcaggagaatgtacccatcctcaccactgatagccaggtggcccagtgctcctacttcaatggggactcagctggagggctcagcctcccattgtcccaagaaatgcatagacagcagggtgtgtagccccaaccatccctgccactggtagacaggcgggcaatgcctcctagaccttctggcccagaggtcctatatctgtgggaactcagccagtgcgcacagcctcctgctgtcccaggaagtatctggatggtagggtgggtgtccccaaacacccctgctgctggaagccaggtgagccatgcctgttagaacttctggctcagtggtcctacttctgccagaatttgctgagggtcacaacctcctgctgccctggaaacacccagagagcagggtgagcaactccactcacacctgcctcccatagccagacagggcccacccaatagagcttccaacccagcagttctgttctacctgcactctgtgaaaaggcacaagcccgtgtttctccaagaagcacatggatagtatattagtgctgacttggcaaggatacagcttgtctgccaacagcagctcctgcctgagggaacaccatggacccgaaaacccaacaaaaaacataggcacagagacagtaattggagggggctcctccaagacccaggagtggactagaattgaaaccagtcaaccaaagccaccttatacaataatgaaacccccaagggcatcaaagaagaaaaaagcaaaaaaaaaaaaaaaaaatccactcaaattacagcaatgttaaagactgaaagaacaacagcccatacaaatgagaaagatccagcacaagaactctggcaactcaaaaaaccagagtgccttctttactccaagcaactgcactagtttcccagcaagggtccttaactaggctgaaatggctaaaatgatggaaataaaactcagaatacagataagaatgaagatcattgagattcagacaatgttgaaacccaatccaagtaagctaagaatcacaataaaatgatacggaaattgatcgatgaaatagccatcataaaaaagaacccaactgatctgatatagcttaaaaacacactacaggaattgcacaatgtaattacaaatattaacagcagaacagaccaagctgaggaaagaacctcagagctcaaagactggctctctgaaataactcattcagataaaaaattaaaaaagaataaacaaaacctacaagaaatagaagattatgtaaagagaccaattataggactcactggcatctatgaaagagatggggagaaagcaagaaacttggaaaacatattttaggatgtcatacataaaacttcctcaacctcatgagacaggctaacattcaagtccaggaaatgcagagaacccctgctgacattacacaaaaagaccatccccaagacccataattatcagatactccaaggttgaaatttaaaaaaaaaaaaaaaaagacaaaggcagctagagaaaacgggcaagtcgcttgcaaagggaatcccatcaggcttacaggagacctttcagcagaaactctacaagccagaagaggtttggagcctatattcagcattctttttttatgagacagagtctcgctgtttcacccaggctggagtgcagtggtgcgatctcggctcactgcaagctccgcctcctgggttcacaccattctcctgcctcagcctcccgagtagctgggactacaggtgcccaccaccatgcggggctaattttttttttttttttttttgtatttttagtagagacggggtttcaccatgttagccaggatggtcttgatctcctgacctcgtgaggaggtcctcctgacccgcctcggcctccccatatattcagcattcttaaagaaaaaatttacaatcaagaattttacatctggccaaactaaacttcacaagtaaaaagaaataagatcattttcttacaagcaaatgcttagggaattcattaccaacacacctgccttataaaaagtcctgagaggagcactaaatatggaaagaccattacaagccactacaggaacacatttaagtacacagaccgatgacactgaaaagcacccacagaaaaaaaagtctgcataataatcagctaaaagcatgattacaaaatcaaatccacacatattagtactaagctaatgggctaaatgatccaattaaaaggcgcagagtggcaagctgaataaagaagcaaggcccaatggtatgctgtcttcaagagaaccatctcacatgcagtgacatctataggctcaaaatgaaggggcggagaaaagtctatgaaacagaagaaatcagaggttacaatcttaatttcagacaagatggactttaaacaaacaaacatcaaaaaatataaagaagggtattatataatacccttcaattcaatggttcaattcaacaagaaggtataactctcctaaatatgacagacatctaacacaagagcacccagattcacaaaacaagttcttagagacctacaaagggacttagaacccccacacaataatattgggagccttcaacatcccactgacagaattagacagatcatcaaggcagaaaattaacaaacatatttaagacctgaatgcaatacttgaccaaagggacggaatagatacctatagaacttgccatccaaaaacaacaaaaaatacattcttctcattgccacatggcacatactccaaaatcaaacacaaaattggacataaaacaatactcagcaaattaaaaaaaaaacagaaattataccaaccacaatcttagaccacagcacaacaaaaatagaaataagttctaagaacataactcagaaccataaaattacataggaattaaacaatctgctctggaataacctttgggtaaacaacaaaattaaggcagaaataaagaaattctttgaaattaatgagaaaaagatataacatatccaaatctctgggaaacagctaaggccatgttaagagagggaagtttatagcactaaatacccacatcaaaaatttagaaagatctcaaattaacgacctaacatcacaaccaggagaactagagaagcaagagcaaagtaagaccccaaagccaccagaagacaagaaataaccaaaatcacagctgaactgaagaaaactgagacactgaaaaccatacaaaagatcaacaaatccaggagttggttattagaaaatattgataagatagatagactactggctagactgataaagaaaaaaagacagaagttccaaataaacacaattagaaatgacaaaggagacgttaccactgaacccacagatataaaaaaaaacattgaagactactataaacacttttaagcacacaaactagaaaatttagaaggctgggtgtggtcgatcacgcctataatcccagcactttgggaggccaaggagggtggatcacaaggtcagtagatcatgatcatcctggccaacatggtgaaaccccatctctactaaaatataaaaaaaaaaaaaaaaattagctgggcccagtggcatgtgcctgtagtcccagctacttgggaggcttgaggcagaggaatcacttgaacctgggaggcggaggttgctgtgagctgaggttgagccactgcactccagcctggtgacacagtgagactccatctcaaaaaaaaaaaaaaagaaagaaaaaagaaaagaaaatttagaagaaatggataaattccaagacacataaaccaggaagaaactgaatccctaaacaaacaaacaatgagttccaaagttaaatcagtagtaaaaagccaactgtattaatgcattcttatgttgctataaagaaatacctgagattgggtaactataaagaaaagaggtttaattggttaacagttctgcaagctgtacaggaagcatgacagcttctgggaaggcctcagggaacttttaatcattgcagaaggcaaagggaaagcatgtatgtcttacatggccagagcagggggaagagagagagaggggaggtgctacatacttttaaacaaccagatttgtgagaattctatcacgagaacagcagtagtgggatggtgctaaaccattagaaaccacccccatgatctaatcacctcccacaagtccccacctccaacactggggattaaaattgaacatgagatttgggttggttcacaggtataaaccatatcatctactaaacataaaaagcccaggactacacagattcacagccaaattctaccagatgtagacagaatagctggtgccattaataatgaagctattccaaaaaattgaggaagagggactcctccccaactccttctgtgaggccagcatcatcctgataacgaaacctggcagagacaaaacaaaaaaagaaaacttcaggccattatccttgatgcacatagatgcaaaactcctcaacaaaatactagcaactgaatccagcagcacagtgtaaagctaatccaccactatcaagcaggctttatccctgggatgcaagattggtttaacatagacaaaacatatgtttgtgtgattcattacacaaacagaactaaaaatgaaaaccacatgataattccaatacatgcagaaaaggcttttgataaaattcagcatcccttcatgttaaaaactctcgataaactatgcattgaagaaacatacctgaaaataattagagccatgtatgacaaatccacagacaacatcatactgaatgggcaaaagttggaagcatttcccttgaaaactagaacagccagacacgatggctcatgcctgtaatctcagcactttgggaagcaaaggcaggcagaccacttgagcccaggagtttgagaccagcctggtcaacatagggaaaccctgtctttacaaaaaaataagaaaaattagccaggcgtgatggcacacacctgtggtcccagctactcgggaggctgaaatgggaggatcacctgagcctgggagctcaaggctgcagtgagctatgatcacactactgcactcaagcctgggtaagagtgaaaccctgaccaaaaaaaaaaaaaagaaaagataaaagaaagaggccaggcgtggtggctcaggcctgtaattctagcactttgggaggccgaggcaggcggatcacctgagattgggagctcgagaccagcctgaccaacatggagaaaccctgtctctactaaaaatacaaaattagcgggcgtgatggtgcatgcctgtaatcccagctgctcgggaggctgaggcaggagaatcgcttgaatccaggaggcagaggttgcagtgcgctgagattgtgccattgcactacagcctgggcaacaagagcaaaaaaaaaataaaaataaaaaataaaaaataaaaaaaaaataaagaagaaagaaaagaaaactggcacaaacaagaatgctctctctcaccactcctatttgacatagtattggaagtcttggctgcagcaattaggcaagagaaagaaataaaaggcatccaaataggaagagagggagtcaaactatccctgtttcaaatgacatgattctatacctagaaaaccccatagtctctgccccaaagcacattaatctgattcacatcttcagcaaagtttcagcatacaaagtcaacatacaaaagtcagtttcattcctataccccgatagctttcaagctgatagcaaaatcaggaacactatcccaccacaattgttataaaaagaacaaaatacctagaaatacagctagccagggatgtggaagatctctacaacaggaattatataacactgctcaaagaaatatgagatgatgcaaacaaatggaaaaacattttattctcatggataagaaaaatcaatatcattaatatggccatagcgcccaaagcaatttacagatgcattgttattcctaacaaactaccaatgccattagtcacaaaacctaaaaaaataaaaaaactgttttaaaatccatatgaaaccaaaaaagacccttatagccaaggcaatcttaagcaaaaagaacaaagctggaggcatcacgttacccaacttcaaactatgctacggggctacagtaaccaaaacagcatggtactggcacaaaaacaggcacatggaccaatggaacagaatagagagcccagaaataaggccacaaccactggatatttgacaaagctgacatcattctaccataaagatacatgcacacaaatgttcattgcagcactattcacagtagcaaagatgggaatcaacctaaatgcccatcaaaggtagattagataaaggaaatgtgatacatatacaccacataatactatgcagacataaaaaggaatgagatcatgtcctttacagcaacataaatggagctggaggtcattatgctaagcaaactaacacaggaacagaaaaccaaaataccacatgttcttacttataattgggagctaaaggatgagaacacatggatactaggaggggtacaacagacactggtgcctacttgagggcggagggtgggaggagggagaggatcagaaaaaatacctgttgggtattatgcttattgcccagtgatgaaattttctgtacaccaaacccttctaacacacagttcatctatataacaagtctgcacatgtacccttgaacctaaaataactattacaataagtaaatacatatttttaaaaatcatttagaatgtcagaaaattccaggattgtattagtctgttcttgcactgttatgaataaacacctgtgactgggtaaatttataaagaaaagaggtttaattggctcacagttccactggcagtacagaaagcatgacagcttctggggaggcctcaggaaactttcaatcatggtggaaggcaaagagcaagcaggcatgtcttacatggccagagcaggaggaagagagaaggtagacgggctacacacctacacaaccagatctcgtgtgaactctatcacaagaatagcactaggaggatggtgctaaaccattagaaaccacccccatgatccaatcaccagacccacaaggacgcacctccaacattggggattatgattgaacatgagatttgtttagggacacagatccaaactatatcaaggatagagtgtagaatatgacaaaataatctaactgtattacaaatgtgtgaaacaacctcactgcaggtggtggtaaaagaagtgcagacctaagtaacttttggaaattagtggagtctgtaatactaaatgaaaaactgtttataaacgccacactcttgtttttcacagggatatgggttaacaattctaatacttctatacgtgtgtattggaattgagcagttaagtaaattatggtaaattgtgggtagtgaggctggtttctctctgctggagtgagagtttatgcctaatcaaagggagggagctaaaataatctctgtggtaatggattacagttggatatattaatattaaatcatatttggcttaatgtagatacacatggctacatacacgtacacatggctacatatagacacatatagatatgtgtacatacatgattagtatacacaaacgttcccttccattgacaaatgagaaggcctagaagcaacagtaccccagtagtaacaagcacatctggcatccagttcatggtttgtaatagcactctgcaataaagggaaacagggcttcttagaaaaattggtgtttctaggactagggcaggaaatatacatgatgagcctgtaacattttgtagtgccagaaaggaaagaagtgctaacaacaaaaacaagcccacaaagatggggctgtgtcaaatagatgtactgaaagagccaataccaagaactcctgacgccaaatctggaacactttggggaaacaaataaagcagtattgaattgtaacacaaagtataaaataaatagccatgagtctacactaatataagtaaataagtgaataaataaataaatgggggcaaagaaacaatcttccatgcagaaaaactccaaatgatttatgtagatatgccaacctaaaggagataaagcataactcctcactgtttcagttcaggccacacatagtgactttcttccaaagagtatagtatgaaaaagggaaataaaagagtaacttgtgatggaaaagcctgacaagcacaaattacctcagcagagtgatcagggtcaacataaacagtaataaatcatatcaacagtatgttctcttgatatgatacgatgaaaatcatctagtcatcctttttttttttttagatggagtcttgctcttgtcacccaggctggagtgcaatggagtgattttggctcactgcaacatccacctcctgggttcaagcgattcccctgcctcagcctcccgagtagctgggattacaggcgcccgccaccatgcccagctaatttttgtatttttagtagagacagggtttcaccactttgaccaggctggtgtcgaactcctgaccttgggtggtccactctcctcatccccccaaagtgctgggattacaggcgtaagccaccgcgcttggctgaaaatcgcccttaacctctgtagtcttcttccccaaaaaaacattatccctgtctaataatgacaaagacatctaacaaatcccaaaagatagatatttaaaaaatacctgacccattcttctcaaactgtcaagatgaccaaagcaaggaacaactgaaaagctgtcataaccaagaggggcctgagaagacatgatgatgaaatgttatatgatattctggatgggttcttggtttgcaaaagggaatttatgcaaaaactaaggaaatttgattaaaacatggactttcagttatggtaatgtcttgatattggttcattaattgcaataaatataccttgctaatgtaatatattcataaaggggaaactgggtacagagttaatgagaactcgctagactatattctaatagttctgtaaatctaaaactattgtaaaaatcaagtttactttaaaaatattactgactgtcttggttctgttttactactttttttttttcttttttttgagtcagggtctccctctgtcacccaggctggagtgcagtggggtgatcttggctcactgcaacctctgcctcccgggttcaagcaattctcccacctcagcctcagaggtttgaataatacttctttgttttaatcattcagctcagattaaaaacaacgcctaatttcttaatgtcaactattgccttgccctctgttatatcctaccttctcccattcgttatagtcactctctagtatggtattgagttggggatgtgcatctgcccaacaaatttttatattttttgtagagatggggttttgtcatgttgcccaggctagtctcaaactcctgagctcaagcagtccgcccaccttggcctcccaaagcgctgagattacaggtatgagccacattgtccagccatttccatttacttttctttcccattgagcccaattcttaaaaacatccagtggcagcttagcttgggtgtcttggctcagctctggaggtttgaatgatacttctttgcttttctttgctttaatcattcagctcagatttaaaaatttcttaatgtcaactattggcttgccccctgttatattctaccttcttccattcgctatcctaactctctagtatggtattgagttggggatgtgcacacacaggcaaacacacacacatacacatccccatacatatacagtggtgtgctgaaactgtgtcagaccagctagagagacccaattgttaaatattcaagaatgaggcaagccagttattaagcacatccattattaaaaattaaaggataaagttacaattaagtaaatcatattaaaaagaaaggttataaataatatcattacttctatttattttactattatctatactttttgaggttaagtctactgtatttctataatggaattactacatactggtgtgctacttcttgattccgtatttggtgatgtcaccctgatatgacatcatatcattgatatgatatgaaatagaccatgggtggagtatttgtaccatggatattgaaaaaacttaaatcagagcttgagttattgttttgttgattttctactttaaaaagatggatgtgcttaataaccggccttaaaaagatgggggaaaatgttatcacggttaatactgtaggttaagctctaaaatgtttgtagctgttacatttgaatagcacaaaatattgaggaatattctttaagtgtttgaaaacagttttaaactcagcaaagaggttaactgatattgttaacaagattcaacttcattcaattctattgttatactctcatcttactcgtcaatataaatgaaaatgtcaattgatattcatttgagagttactctcatttgttaattgcaaccataggttaactaaagatacaagagtttggctaaatcagtgagaacattgtatgagaataagttcattatacagaatagagaatattatatattttattattatttgtaagttttgtattacatatcctttatgtcagtaaaatttataataaacatgtacatatttattttttgcagtttgttattaaacagttactagcaaattgctatgtacacacattccttatcaaaaatgtgggaattatttgcaacataaatgagaacatatgaggttatacgtagtaggtacaatcttaaagagacaaaccacaagtatgattgatacttccactagacatcttgtcaagagaattatattcccaaataagtatcaccaaaaattttgttgaaactagacctttccacaagctatgggctcctataaatacatatttttaccagagtttcttcatctaattaggtttttaaattgtggtaagaataagatacagataaatgaattagatgcagcctggccaatatggtgaaaccccatctctactaaaaatacaaaaattagctgggtgtggtggcagacgcctgtaatcccagctactcgggaggctgaggcagaagaattgctgggagccgggaggcagaggttgcagtgagctgagattgcgccactgcactccagcctgggcgacagagcgagactccaactcttaaaaaaaaaaaaaaacaaatcaattagatgtattaattaggaatctgctatgaactgaattgtgttcccccaagatttacatgttgaagcgctaacctccaatgtggcaatatttacagatcgggcctttaaagaggtaattgaggctacaagaggttgtaagggtggagccctaatccagtagaactggagtctttacaagaggaagacacaccaaaggtgcatgggcacagagaaaaggccatgtaaggacacagtgggaaggggccatctacaagccaatgagagaggcctcaggagaaaccaaatctgtcaacatcaacatcttgatcttgtacttccagcctccagactatgaaaaaacaactattgtttgagccgccctgtctgtggtataccatgtaccatggtgtttgtagggaagccctagtaaactaaaacaaaatcttagattgtaagtaatagaaatcaactgtaggtagattatagcagaaagaggacagaaatgcaggtaaaagttacaactggaaactgcagtgctataggaagcccaagatgttctctttttctgtatctcctctctgctatagcctatctattttattctgaacatctttattccacacatctttattccacagctatactgtccaatatgatagtcacaaggaacatgcggctttttaaatttaataaaattcagttcttcagtcacattaaagatattgcaaatattaaatagctacatatggctactgtgttggacactgtagatatagcacacctccatcattgtagatagttcttttggacagcactggattataggattaccagagatcaaggtaaacttcccttgaagttgaaggtaaacttccatttaaccattaggacacctcagctgtatcactcccttttaaggcctatatttagttttgaatttataattttttatcatttttcttagggactgatatcaccagtgacctctagggaaaggattagtagtgaggagaaacattattttgtattgtttgaatgtaaatacatccatgtacaaactgcataatattttttaaggtattggagttttgtattgctcatcattgtatccaaacacccagtatagtaccttaacaggtaatgttaggaagtcgaagagatggacatacggttaatgctaaatcctgtgatggtgagaagatgctctggttatgcctaattctttctgcttcaagcccagctaggtctgggaattgcttggggaaactggaagcctgaaccagaggactgtgtgcatgtgtgcatgcgtgcgtgcgtgtgtgtgtactggtaggtaataaataactactgtgtatctgacactatggtagtttatactttttatgtctactctaaacaacaacactacaaagtagtcacccttgtacccattttataaatgaggaaactaagactaactcatttatcctggtgtgttcttttttcttttcctgttagtgcaatttgacagttacacaattgttactaaatagaatgtagccagttctagagaaacttcattctaccagtgtttattttattattttattttttattagataattcatactcttggatcaaaaactggtagcaaattgtatttagcacgaagtaaatcttccttcacacactaccctcaggcaaccgtcaacaacttcttgtgtgtctttacagaaatattttatgtgtatacaacacatatacgaatatttctaaaatttaatttggagtattttacatactccaaatcttttttttcacttgacaatatatcttgaaaatcattatatattactagatctgctgaatttcttttaatagctatatgttatttgttgtaggaaagcctcaaaatttattcaaatccctactcatttatgattgttgtttcatatcttttgttattacaaagcttcagtgaccattcctataaataggccattttgcacatgtggaaatatatctgcagaataaatttctagaggtagagttgctgagtcaaatttaaaggcaaagagtctttaaactcttcatagatattgctaatttttatccatagatgttatacaaatatacttcccctcagcaatgtttatccataccctttccaatactaagggaaccctttcttgtacaagagaaaaagaaagaaagaaaaatcaatctaatttgcttataggcacctaaagatttttttttttttggccttgcccagaagttatgcatttcagtgaaccctaccctcaccatccccatttcctggaataatattaatactactttccaactgaaactctgagatcacattctttcttttctattttatataatactggcctactttatatatgactgggatggaggttgttcattctgctcatctgtgtattatgcaaatttgcctccaagcagattggcctcttgcaaccctggtgagaggtgacagcatgctggcagtcctcagagccctcgcttgcacctcccctgcctgggctcccactttggcggcatttgaggagcccttcagcccccacctgcactgtgggagcccctttctgggctggccaaggctggagcccactccctcagcttgcagggaggtgtggagggagaggcgcgagcgggaaccggggctgcgtgcggcgcttgcgggccagctggagttccgggtgggcgtgggcttggcggccccgcactcagagcagccagccagccccgctggccccgaggaatgagggacttagcacccgggccagtggctgcggagagtgtactggatcccccagcagtgccggcccaccggcgctgtgctcgatttctcgccgggccttagctgccttcccgcggggcagggcttgggacctgcagcccgccatgcctgagcctcccacccactccatgggctcctgtgctgcccgagcctccccgacgagcaccaccccctgctccacggcgcccagtcccaacgaccacccaagggctgacgaatgcgagcgcacggcgcaggactggcaggcagctccacctgcagccctggtgcaggatccactaggtgaagccagctgggctcctgagtctggtggggacgtggagaacctttgtatctagttcagggattgtaaacgcaccaatcagcgccctgacaaaacaggccactgggctctaccaatcagcaggatgtgggtggggccagataagagaataaaagcaggctgccggaggcagcattggcaacccactcgggtccccttctgcaccgtggaagttttgttctttcactctttgcaataaatcttgctactgctcactctttgggtccacgccgcttttatgagctgtaacactcagtgcgaagatctgcagcttcactcctgagcccagcgagaccacgagcccatggagaggaacaaacaactccagacgcgctgcgttaagagctgtaacattcaccgcgaaggtctgcagcttcactcctgagccagcgagaccaggaacccaccagaaagaagaagctccgaacacatctgaacatcagaagggagagactccagacgcgtcatcttaagagctgtaacactcacggcgaaggtctgcagcttcactcctgagccaacgagaccacgaacccaccagaaggaagaaactccgaacacatctgaacatcagaagggacagactccagacgcaccaccttaagagctgtaacactcaccgcgagggtccgcggcttcattcttgaagtcagtgagaccaagaacccaccaattccggacacactgggtcactttctgactgcactttcttgaagtattcgtctttggtcctgtggtagtacccagtggacaacctcacttgcctgtaaactacttccttgaggtattttccctaacaacgtgaaatacattccatttctctgcttgctcttttcatgactctcatttcaatggtccttagaaaacactttttttgattattattcagctttgtaatacttatttcttcagttccccatccataaagtctttgatttagaggtcaaatctgttttgctttactattcctatctaaagcttgaaagtatggtaattaataaaaacattccacatgttaaattagctttaatgttagctttaaaagaagatagcagttaatcagtcttgatgacgtagaggttgacaggtagaaggatcctaaaatttaattcctgggctgctaacttcaaatctcatctgtatcaacagttttctcacttaagtcattaacatcgaaaattattttattaaatgatttataattgggagagtactatttctctttctccccacctccagttatgagaagatacttattcccagctttttctgggtagagctattcaattttttttttttttttttttttttttttttttttttttttgagatggagtttcactcttgttacctaggctggagtgcaatgctgcaaaatctgctcactgcaacctccacctcccaggttcaagcgagtctcctgcctcagcttctggggtagctgagattacaggtaagtgcccccacgcccagctaatttttgtatttttagaagagatggggtttcaccatattagtcaggctgatctcgaactcctgacctcatgtgatccacccgcttctgccttccaaagtgctgggattgcaggcgtgaaccaccgcatccagcccaatttgttttttaaatctttttggcactctaccaaatcacgaaggctcttcttagttaggggaacagaagggatttagtcttaataaatttttctccatgccatggggaagactctctcagaaggtagcatctagaacagaacattgaaaagtttataaacaacaccagtacttcatacttttgttttatcttccctttgagatagacgtttagtcctttactgttattacctagcacaatatctggcacacagtaggtggccactgattatttcttgaatgaagtaaggaatgagaatattacctacagagttagagctctgcgcattacttccttccagatttcatacatctttttttagtaatgaatgcaaacaggctctggggcagctacattatccttctgaatcaagacagggatttcgcaatgcttattttcaatttcttcagaaatgccttaaagatattaatggaggtaacaacttaatctcaaatagtaatccatagacagaatatgtaacagcaatgttctctgatctgttctttggcttctattccctagagaaatagttctctaagaccaaacagtctatagatagaattgtagcaacagtcaattatgatgttagctatttgagagacggttgagaattcagaaaaaactactgaaatgttgtaagacaactcactcaaagaacagttcaaatagtggaaaagggaaatgatgatgtatccatttattttgttctattttttccaatttcataggatagcaaatgctgcccatttatttatttttttatttttcataagttattggggtacaggtggtgtttggttacatgagtaagttctttagtggtgacttgtgagatatgggttcacccttcacctgagtaggatacactgaaccatatttgtagtcttttatccctcgccccctccatctcttccccgtaagtctccaaagtccattgtatcattcttatgcctttgcattctcatagcttagctcccacatatcagtgagaacatacaatgcttggttttccattcctgaggtagttcacttagaatagtagtctccattctcatccaggccactgcaaatgctgttaattcattccttttcatggctgtgtagtattccattatatatatatatatataccacagtttctttatacactcattgattgatgggcttttgggttagttgcacgattttgctattgtgaattgtgctgctataaacatgcgtatgcaagtatcttttccaaataatgattccttttcctttgggtagaaacccagtagtgggattgctggatcaaatggtagttctacttttagttctttaaggaatctccacactgttttccatagtagctgtacttgtttacattcccaccagtggtgtaaaggtgttccctgctcaccacacccatgccaacatctactgttttttgattttttgattatggccattcttgcaggagtatagcattgtggttttgatttgcatttctctgatcattagtgatgttgagcattttttcatgtttgttggtcagttgtatatcttcttttgagaattgtcttttcatgtccttagcccactttttgatgaaattgtttgtttttttttcttacagatttgtttgagttcattgtagattctggatatcagtcctttgtcagacgcatagattgtgaaggttttctcccactctgtgggttgtctatttactctgctgactgttccttttgctgtggaaaaactctttagtttaactgggtcccagctacgtacctttgattttattgcatttgcattttggttcttggtcatgaaatccttgcctagtcaatgtctagaagggtttttccaatgttatcgtctagaatttttatagtttcaggtcttaggtttaagtccttaatccatcttgagttgatttttgtataaggtgagagatgaggatccagtttcattctcctattatgtggctagccaattatcccagcaacatttgtttaaaagggtgtcctttccccgttttatatttttgttcgctgtgtcaaagatcagttggctgtaagtatttgggtttatttctgagttctctgttctgttccatcagtctatgtgcctatttttatactagtacatgctgttttggtgactgtgcctttatagtatagtttgaaagcaggtagcatgatgcctccacatttgttctttttgcttagtcttactttggctgtgcaggctcttttttggtttcatatgaattttagaattgttttttctaattctgtgaagaatgatggtggtattttgatggggattgcattgaatttgtagatttttttggcggtatggtcattttcacaatattgattctgctcatccatgagcatgggatatgtttccatttgtatgttgtctattatttgtttcagcagtgttttgtagtttttcttgtagaggtcttttgactccctggtaaggcatattcctaagtatttgatttgatttgatttttttttttttttttttgccgctactgtaaaaggggttaagttcttgatttgattttctgcttggtcgctgtttgtgtatagaagagctactgatttgtatacactaatcttgtatccagaaactttgctgaattcttttatcaattctagtagctttctggaggagtccttagggttttcaaggtaaacgatcatatcatcagcaaacagtgacagtttgacttcctttttactgatttggataccctttttatttttctctctcatctgattgctctggctagaacttccagtactatgttgaagaggagtggtgagagtgggcatccttgttccagttttcagaggaaatgctttcaacttttcccattcagtattatgttggctgtgggttttcatagatggcttttattacattaaggtatgtcccttgtatgccaattttgctgagagttttaatcataacaggatgctgaattttgtcaaatgctttttctgcatctattgagatgatcatgtgatgttttgtttttaattctgttttcgtggtgtatcacatatgttaaatcatccctacattcctggtatgaaacccacttgatcatgtcatggtggattattttttgatatgttgttggattctgttagctagtattttgttaaggattttagcatcaatgcccaacaaggatatcaatctgtagtttttaaatgtgcttttctggaccggcacggtggctaaggcctgtaatcccaacactttgggaggtcgaggagggcggaccacttgaggtcaggagttcgagatcagcctggccaaaatggtgaaaatccgtctctactaaaaaggtgttgtggcgggcgcctgtaatctcagctactgaggaggctgaggcaggagaatcgcttgcacccgggaggcggaggttgcagtgagccgagatcgcaccactgcactccagcctgggcgacagagaaagactccgtctcaaaaaaaaaaaaaaaaaaaaaaaagttgttttctgctatttcctgaactttattacgtaaatgagacacgtgagatctggaaggaggtggaggtgaagaccctcccacctggcctgcatccagagtacttggggtgtggcactggcgtgggccccaggaaggatcccagccagttttggtgctggaggcccggccaaaggaagggctgctctcccgtcccgcgggctccgaggtcgccgcacccgggcgcgcctgggcctcgtcacccgcgctcgtgacgcgtgcttacaaaggaaacttttacaggtttcggtgggcagggccttttattgcccttctgctccacagcccccgtgcttaatcggttggttgggaggtttctttcgtccgtggttttggaaagtccccgcctccaaaccgcagtcccgcagtcagttctgcagcctcagggcctcgaacagccatgcttagaatccgtccttctttcctgctccatctacccttcccctctggcttcttttttttcactggagaaagcccacccgagtctctcagcctgcttcggaggttactgcggcctcctccacgggtagttctgggacccgggtctagtccgcggttccggagcaggtccctccctggagtcgtcaggcccagtatgcgtgtgctcagtgtgctcgggaaacacgcgtgggctttaacagcagatctccataaaagggtcccggagatagcctctgcctggcccgaggcccagtgcctcaaagcggacgcctttgcgctcccggaggtgctcacaccacagcggagcctgctggcgagtggagcgtaggactgcgaaccagcaatctcccgagaagcggcgagggggaggggaatgtctgtgaatcggttatccctcccacccccagcagaagtcggggaaatgggggtggaagggggaaaaagggagagaacaggagtggggttgaggaagggtaaggaggaaggtgagcttcctacagctgcgggggaaggtggagaaaattttcagggggacagctgagtggtagagctagcgagcttcagagaaatgttgacagacagatgcccagaaagtgaggatgccgggcatgggcactgcgtaccaggcacaggagatatatggaggcaggaaattggcacatcataagcatttgaccatcctgccctaaaacaaaacaaattgaacaacaacaacaacaaaagataatagcaaaagtggcacagtagtgagctcgcagggcccattcctatatagaaacacagaaaaataagcaaaagctgccagaattgacttcgtgggaactctgggaaacagtaagaaagttttacagcaaccaagtgagtgctgaaccaaggcaaaggtaactgaaacgcaatgatagagaagaggggcagggaagtgttgggtagacaaaggcgggtccctggtaagggccctcccctgggcctgtgcccactggacctaggtgaggacaggcactccttccttcacgcccaaatgttgcatatcccaagaccaccctgtcccgccacgcccccatcctttgcctatgaaaaccctgagaccctagcaggcagacacacaagcggctctatgtccagaggaactcatcggaggaactggacgtggagcggggcaccccagcggaagggagcacgccagtggaagagcacactgacagaccataggagtcagtctgttatattatcatagtataatattataaaattattataatacaataaaaatataaaaatataaataatgtaataaatatggataaaaataataattacatatttatatttatatgagaacactatgaataattttaagccaaaaaacaactcgatgttcatcactggatgagtagacgagcaatttccagtatattcatacaatggaatatgattcagccataaaatgaaatgaggtactgatacatgctgcagcaggaatgaacccccaaaacactacacttggtgaaagaagccagacacggaaggtcacatattgtatgatcccatttataagaaatattcagaataggtaaatccatagagacaaaaggagttttgtagttgccaggagttggaggcaagaagagtttaacaggtatgcttaatggggcctcctatgcagttgacgaaaatgttttgggctagataggagtgatggttgcataacattgtactaaatgccactgaattctactctttaaaatttttagttttatgttatgtggcgtgtaccctaaaaaaaaaaatagaggtgcagtgctccagcacgggatgaggcagcgtggacaggagcatctcccaacctcagtgaagtctgagccgcgtgcctgcaacaatcccactgtggcagagaaccgcagagttccttccggtttggcagcagtcattcgcaacctcacagccctctggaaccccagcctgggggtctcagaacgccgaggcggggactgggagccgagtcggattccgagactatgggccagggttggctggattcagttacctggctgaggcctggtgagcaaaatatcccaaacctcgcgtgatctggaaggggaagccggataaatacggatctccagatgtgccagtctcgagtctatcgatatgaggtccccctagagtttctattcatcattttaaccgcatttcatcgatcttgagacacggcttttgatattttatcacctcaagataaatagtgttagatgtctaatagcagcgtttttctaagagatacatgaaacaacagtgtcagaaacgatgctgtcttccatgcgatgaaattgttgtaataggtgctcaataaatgttgacaataaatgagtgaatgaatgaaaattattttatttttatttgagctttggttctgccatttgctagcagtgtgactcaagagaagccagtaacccccctgagcttccctagttcacaaaatgcttgtcatgaagtcgacagcttccggaggctgcgaggctcgcaagaaatgcccacatgaatgtgcgcttagggcgtgagtgctcactccagaaaactccaacacagtgaaaaggcagaagcggtgtttttcttttttacatttttataagaatatataaaaaatgatataaatggacatttacggtagtgggggaaggcatatatctacgttaaaaggcaggacatttttaaaagctctattttctaaatgaaaactacgaaagcggggtgggttgtggcgggggcagttgtggccctgtaggaccttcggtgactgatgatctaagtttcccgaggtttctcagagcctctctggttctttcaatcggggatgtctgcagagggcagaaagaaaacaggcgttagaaacctgaggtcaaagatgtgtggcacatcccgccctcctctcttgccgtccctaccggcattgaaatacttatggataaagttctcgcaatggcttcacgtgcatgtacccgccgccaccgctctcccacacctccctggtccagcagctagtccactgcccgcctggctgctccaggcgcgccgaccgctcaagcgctccaggtccacccggcggagggcagagaaagcgcgaccgcgcggcccgcagggttgcaagaagaaaacgagtgttatataatgagtctcagtggttgctcacaatgccaggcgcgaaggcgtgaagatgtggcctttcccttcccgcatccccaggcatcttttgcacctggtgcggagtgagccagccagcttgcgataaccaaagggcgcctcaggctctggcgctcctcggcggaatcccgtagcttccctacgcatgcctgcttctacaaacccacaaatggtttccgatcatttctgaaacaaaatggatgctcatttattcatgtgctctggcttctgccttcctctctaatctcgttgcgtatgggctccagctcgccgttcggttctcccgaggcagcatttacacttgagagtctcaagattattttattcctgagggagcatttgcacttgaaagtctctttttacgtttattcctgaggcagcatttgcacttgagtttctttctcccgtagcttgcattagattctccgaccactctttagcttctcctcctattcacacttcatatttacccattgcattggttttataaactcgctctctgaaaatagattgttatcttccttaacgtctgtttcccaggtcgggcaagatagcttgggactgtaatcccagtactttaggaggaggaggggggatgatcgcttgagcccagataacatggtgagaccttcgtctctattaaacaaacaaacaaacccaggcgtcgtggcgtgcacctgtggtcccagctagtcgggaggctcaggtgggagaaccccttgagccagggagtttgaggctgcagtgagctgtgatcgcgccactgcactccaggttgggcaacagatcgactctgtctccaaatgtaaaccccatgagggcaagactcttgtttggtctcattcaccttggcgtgcccaccacctagaacagggctgatcacgcagtagaatctaaccatataattaattgtgcttgaagagggggtgttggggagtaagagaaggaagggaggagggaagaaatgaaagacttgtgtgtttggattaaatatattaggtttggttaagagtcgttcagtttattcatttgcttgtggcccaattcagtagttttactccctctcccacttggctcctcaggctttttgctcagccctggaaccgcgctgtaattggcagctccttctaaatcgggacccggatgctagctgtaactggagccgaagtctccttcttcacctcccgggacctggatgctagctgtaactggagggaattggcgggggggaggggaggaggggccgagtaaagaagaacttcgcgtctttaacttcgaaggtgattttgcgttctgtatttacagcatctccaagcagagggcttagagctaactcttcaccctgtcctccccagctcccctatggcccaaggagcccaatgcccccgttctgggccaaaataagatggatttcataatcttcaaggtcatgttttaccttaaatattcgtgttaattcccgtgtactgtttcatatatctattttgtttcaaaaaaaaatgttcctccccccagaaacaattgagtaatgttggcagtttcagcagacagctgtgggagtagggaactggggccatggaatgggggcggagggaggatgctttgagatcacaaaaaggaaaggcaagggcaaggaggaccataattctaccttcatcgctcagcgatctcttgcacaagtttaagagggaaaggagccaactccggtgcacagactgccagggtcagcgaagtcttggtcctgatgtccccagaaccccctggggcagctctggaaaactctaccgcataaagcggagggtcagattagctgaggagggtcagattagttgagttgtgcagaagagccgagatcgagagatctccagatgatgccacgcacaattgggtttggaaatcctgaggttggtccagccagcttggtatgcaaatgaggaaacagacctggtaagtggatgcaactggccctagtttggaggaagagggggcactagacctctagcctcttgagtcttcattgctccgcagtctaggccttgaactagcagagggtaggtgtttgggtggtggtatgctttgggaagtataatgtacaaaatgggctttcacgtgcgcaagtccatttcgggattatttcccatttgccgccctggcggggcagggcgatagggagactcaggccgtcccaccgattggcgcgtgagctgaggcaagaccggagactggtctcccgggctgaactttctgtgctggaaaatgaatgctctgagctttggaagctctcagggtacaaattctcagatcatcagtcctcacctgagggaccttccgcggcatctatgcgggcatggttactgcctctggtgccccccgcagccgcgcgcaggtaccgtgcgacatcgcgatggcccagctcctcagccaggtccacgggcagacggccccaggcatcgcgcacgtccagccgcgccccggcccggtgcagcaccaccagcgtgtccaggaagccctcccgggcagcgtcgtgcacgggtcgggtgagagtggcggggtcggcgcagttgggctccgcgccgtggagcagcagcagctccgccactcgggcgctgcccatcatcatgacctgccagagagaacagaatggtcagagccagggtgggggccggcatgacggaaaggaagcttgtgtagagccccctcaccgccaagcagacccccacacaagccccaggtgtctaattacccctacatttgcttccagtttccaatttccttcttgagttctctatccattcttcagtacacaatgaattccattatatcctccgaacttctgcggagctgtcgtcacaggcagagagcactgtgaggcacgggcaaaatagcaaaggggcagggacagactgacttttactccaggctaacttcctgtatttcccctgagatacaactactgaaatttcttcctgaaattatgttaggcctggagatttttttttttttttttgttcactgctgtatatccaagcgcagaatgtggtaattgttaaaaagagaaaacttgtttgtttgttaaaacaaattctcacaaaacttttaagttacacttagcttctgggaatgttgaacttcaatttctttttcattatattagttttaaaattatatattgggatagtacagttgtatatatttatgtggtacaatatgaagttatgatctttgaacacaatggggaattattaagtcaagctaagtaacctatccatcatctcaaatatttgacatttttgtcaaatgagagcatttgggatttactatttagctatattcatcatgctatgaaacacatctcaaaaaaaacaatcaaacttattcctcccatcttaactgaggctttatatcttgattaccatctccccattcctcccaccccccagctctagtaaccaccattctactctttactgctaagaatgtaattgttttatatttcacagataagtgagaacatgtgatatttgtctttctgtgtttggcttatttcatttagcataatgctctccaattccaaaacttcaatttcttcaagtataaaataagaaggctagtttaattaaccctaaaattccttcctgtggtaggctgaataatgcccccccacccccaatgtctatgtcctaatcctcaaaaacttttaatacattaacttatgtggcaaaagaggctttgcagatgtgatttaattaatggtcttgagggagattatccagaattttcagggtgggcccaacataaccccaagtgtttttattagagggtcacagtcagagagaagatacaagaatggaagcacaggccacagagaaaatacagagaccatgagccaaggaatttgatggtcactagaagctggaaaagacaaggaaacagattgccccttagagtttccaaaaggaatgaaaccttgtggacccatttttgacttctgatctctagaactgtaaaataataattttgtgtttgttttagctaacacatttgtgataatttgtaacagcagcagtaggaaactaaaacacttcccaggtttatgatttgagagttcattaaacaagagatggtcacctctttggttcctaaatcatcttggaaacaaagccatttccagagaggaattttaaaatactgtctgcagtcatagcaaccttaaaatttgagtgctgcatggtggaagtagacaatttattttaggataactgttatttgttatattagtttgaggatggtggtgttaaagaggagttacttatttttaggtacatttcatactaaacacaaattgcataatttgcctaaatcaaggaattatactaaattatattatggttattaaatcctgtcctgagaaagtgaaactgactcagttttcaaagagacaaagagaaagtataagcaaaccaaattgcagctacaaaaagaaagacaaaatgttgcagtatatttattgttttgtgtattcaatgaagtccttcgtcttggtcataaaactagccttaaaggtttttcttatatttcatagtatgaaaaatctaaaaagtaacccatatgtaaatatttaaatcatgatagaaatccaaagcaaaaagaaaatgaatcaattgaattaaaatgtgtaggatgcttaaacccatttgataatatatccatttgataatatactaatatgaatttagtactttaaaatgttatataaataaatgttcctatattaaacaccaatgtagttaggattctaagccaacatcatttccccttttctacatgttcttctcccgtctccattaaaaattgtcaaaactatccacttttctttttcctttttgtttttaaacaaataaggtctcttctaagatattgtaggactacaaagccaaactcccgggttcaagctgttggcaaaattttagagatgctaagttacccatgtattaattacttttaaatcctcccctaactccctcacaaaacaggagtagggagaggagaaacacctctgttcaaaaatgaggaattgaaaactcttatcacaaataaactatatcaagtaagctaaagatagtaaaagagcaaaaatgttagcagatattcccaaaatggtaactacatattacctctggaatgatcacatgaatgtggctcattatttcctaagttcctacagcaaacatatatttatttgccctactcagttaaaaataaacacaatatgtagttgcttctgaataatttttctctctctctttctctctttctttctttcgacaaagtctcactctgtcacccaggctggagtgaagtggctccatctcgctgttcactacaacctcagcctcccgggttcaagcgattctcctgcctcaacctcccgagtagctgggattacaggcgcctgccaccacccccggctactttttgtatttttagtagaggcgaggtttcacctgttggccaggctggtctcgaactcccgacctcaggtgattccccccgccttgatctcccaaagtgaagggattacaaggcgtgaggcaccgcgcccggccgcttctgaataatttcgatcaaaatttatattcgatatttattccaacatacaccacagatttccactgataatccctcctagtaagaaagataagctccatccaggtatctgtgaattggaggctaagtagtcccagcacatcttacatttctttaagactccctttttatcccaaacgttcgtaaattttgtatctgataaagagcatacttccatctaatacaaatatgttccccccttcagatcttctcagcattcgagagatctgtacgcgcgtggctcctcattcctcttccttggcttcccaagcccccagggcgtcgccaggaggaggtctgtgattacaaaccccttctgaaaactccccaggaagcctcccctttttccggagaatcgaagcgctacctgattccaattcccctgcaaacttcgtcctccagagtcgcccgccatcccctgctcccgctgcagaccctctacccacctggatcggcctccgaccgtaactattcggtgcgttgggcagcgcccccgcctccagcagcgcccgcacctcctctacccgaccccgggccgcggccgtggccagccagtcagccgaaggctccatgctgctccccgccgccggctccatgctgctccccgccgcccgctgcctgctctccccctctccgcagccgccgagcgcacgcggtccgccccaccctctggtgaccagccagcccctcctctttcttcctccggtgctggcggaagagccccctccgaccctgtccctcaaatcctctggagggaccgcggtatctttccaggcaaggggacgccgtgagcgagtgctcggaggaggtgctattaactccgagcacttagcgaatgtggcacccctgaagtcgccccaggttgggtctcccccgggggcaccagccggaagcagccctcgccagagccagcgttggcaaggaaggaggactgggctcctccccacctgccccccacaccgccctccggcctccctgctcccagccgcgctcccccgcctgccagcaaaggcgtgtttgagtgcgttcactctgttaaaaagaaatccgcccccgccccgtttccttcctccgcgatacaaccttcctaactgccaaattgaatcggggtgtttggtgtcatagggaaagtatggcttcttcttttaatcataagaaaaagcaaaactattctttcctagttgtgagagccccaccgagaatcgaaatcacctgtacgactagaaagtgtccccctaccccctcaacccttgattttcaggagcgcggggttcactaagtcagaaaccctagttcaaaggattccttttggagagtcggactgctctctccttcccctccccttcccctcctgcgtgtaaaacggctgtctggggcaagggtttctcagacgtgtacattgcctggtataagagcagactctgaaaagatgaggtttatttaatacggacgggggagaattctgcctgtaggcagataggaaaatggggagggagtcattggaaggacggactccattctcaaagtcataattcctagaccagaaaaagtgctcagtgttctagaagcagagttgcacagtgatccaaagaccagcttcaaatactgtcctgtctccttcacacttctcacatttctctttcctactgaaaataccttgcatttttcgtaattataaagggggaagggaatatgagtgccccctgctttataggggttgttgtgagtttaaatgatgtattaatacatataagccttaagaacagtgccacacatcctaagctaatacctgttagctcttgaattatccgctttgaggactggcttgcaatcttgttttgaggcatagaaagaaaatgctttggagcaggacgcggtggctcacacctgtaatcccagcactttgggaagccgaggcgggcagatcacctgaggtcaggagttcgaggccagcttggccaaaatggtgacaccccgtctctactaaaaatacaaaaattagctggccatggtggcgcacgtgtgtaattccagctactcaggaggctgaggcaggagaatcgcttgaacccgggaggcagaggttgcagtaagccgagatcgcgccaccaccctccagcctgggtgacagaatgagactccgactcaaaaaaaaaaaaaaaaatgctttggatagaattatcactattacataaaaggaaagtccggatgcggtggctcacgtctataatcccagcattctgggaggccgagacaggcggatcacctgaggccaggagttcgagacaagcctgaccaacatggcgaaaccctgtctctactaaaaaatacaaaattagcggggcttggtggcgcatgcctgtaatcccagctactcggaggctgatgtaggagaatcgcttgaacccaggagaaggcggaggttgcagtgagccgagatcgcgccattgcactccagcctgggagacaagagcgaaacttggtctcaagaaaaaaagaaagaaagaaagaaagaaagaccaagaagaacttactccctgaaaagattatgggcaccctccaccaccctcacttacaaagaaaagttaaacagcactaaagagtataacaagcgcaaggaggtaaaagttctaatttttcctgtgactactactttttaagcttatcaaaaacatgtactacgttttaaaaaatggattgctcagactttgctgatgccttaagcacatgcttaatctgcctactggataatccagctctgtttaaaagttatatttcaatccctggttgacttaaaccttgtagacccagtatatcttgtacttttagtgtctgcttgattttaaaacatgtagtttttaaaatgaagccaatgaaaacaatttgggatgtcaagtatgttattaaaatctacaatgcattactgtaccatttatattttcctcggggtacctctcaattagctgtgtagcaatgatagggaaaattcaaactatcgataaataaaattattttagtttagtttaagatattttatgatggaggaggaagaaagtggttgccaggatgggagggagggaacacatttccatcactaatacaatggttctttctttttgtttgtttgttttgtgtgtttttttgagatggagtttcgctctgttgcccaggctggagtgaaatggcaccgcacgatctctctcggttcactgcaacctccgcctcccgggttcgagcaattctcctgcctcagcctcccgagtagctgggattacaggcacatgctgccatacccagctaatttttgtattattagtagagacggggtttcactatgttggctaggcttgtctcgaactcctgacctcaggtgatccacccaccttagcctcccaaagtgctgggattacaggcatgagccatcgtgcccggcctacagtggttcttaatgggggtgggagagtgggaagagtaggctccttcaagagtctgttgaaataaataccttcttctcaaaaaagaaagtaggtaatgattttttttaaaaaagatgtgttcacttgcacatgtatttctagataaaactttcagtgaattcagggatttctctgaaactctaccatggattcctacatcaagaactctttcagctcttgtgaaaaatatatatagctattggtgaagaagatgggagatgcaaccatataaaaacaacatttggatgcattataaacaggtgtaaaagttgactgctttggaaataccaagaacaagttttagatatgtatatctcatatcttgcagtagagctctggaaggattatggcatccttgggtggggccattttgctctagaaattgaagtccattatccattataaatcttatgtaggggggaggggggagggatagcattaggagatatacctaatgctaaatgatgagttgatgggtgcagcacaccaacatggcacatgtatacatatgtaacaaacctgcacattgtgcacatgtactctaaaacttaaagtataaataataataaaattaaaaaaatattatgtaaataattaataatagtgggaaaactttcctagtttttctgttaaagagcccattatactcccagtttactcatacatatcgacctgaggtgcaaaatcctagaagaatgaaaatataaagtcctggatctctgtgctccttatgccagtctcagatttcctatgtgcaaaatgggattataatatatttcatgtggccataaaatatgataatgtatgtccaaaagcttttaatgtaaaaatttactacatttactaaatttactaaagtttgttggttattgttattattattctcacacttacttttcctctttcctgagaatgccattctttttttagatttgcactgcctttgcagttttgaaaattctacacgtgaaatttaaacctgtcttaattctgatcagtcttataacaaaaaaagactaccacctgttcattcattcaacaagctcagaaactaagggcagacatggggtgggggcagaggggagtaggtcaaacatagtatctctacagtcagactgccagggttcaaacctcaactgttccacttattggttctttaacttttatcaaagttactcaacatgtctgggcctctgttttctcatttgcatgattaggataataactgtacttgcctcaaacagttgtttagggattaaatgaagcatgtaacgctcttagaagagcaaaataaagcacagaatgatacaagaaaatgaaaaggtgaccaaactcattctcatttgtctctagtaggcaaaggcttccggatgctgagagctgatcccagtcttgaagaatgatgtgagagtttaaagatggaaaagaaggagaaagatattctaggcagaggtaagaggatgtgcaaaggcatagaagtttaggaaaactgaaagtgattcatttagacttattcctgaaaaccagcctgtgaaggactcctcagagagccaaaagaaaaactaggataatgggatggcaaggaagtggggacactgcgttgactactctttcatagcttggttgtgatagttcaaggccctatgccatgaagtgaggcagatggaaggtggaggagacctgagcacacatatacctggaagggcaagtgccaagtgaagagaagggaaagttagaaaagaataaaagaaaagttaagtacacaggcaagataggatatttttgaggacttgaggtccctcaaaaataatgaagaaatagaactcaaagtacagcggtggttatagattttgtcacaagagatacatagatttgggagggagaaaaggtcagaacggggaggaagttgaggcacttccttctatgaatgaggaggttagcttgtttgcagagtgaaaataagatggtcggttaggaagtttgagaatcgtaaaggtttggaatacctcttatgagtagagaggatgggttgagtaagactcagacagagaagccttttgttttgttctttaaaaccagactggagaacccagctgagggtggagatcatgacacagtagggacacctgattactttctttaaactaaagaaagccctgcagtggtgctactacttcagcaaccctacaaatcaaagactagtcataatagatgtgaatattaattcaacatattaccataaagagacagaaagatacttgagaaggtagtgttccagagttgggttctggttctgatgcggcattgtaggattggcaatatgcacgtatttcatgggataagcaagatgattttgttaggaaaataaagggagttgaggcaatagctctacactgagaccaagtgacagttctcatgtatctaatgaactattttttgactgcaaaatcttttgagattatttctagattcattgtccataattttcaaaatgggctctctcttgttctattgtttacgcttgaggtgagataatacacacatatttctttaccagtttcaatattaacattattattaaagataattgttttaaatatagcttggtgttaaaaacaaaatatacatagaatatctctggggagatacaggaaaagctgttacctgtgaggtaaggaaatgaagaactgggatgggcatgtgacttacttttcacattccatgatttatattgtttgaattttgtactatgtccatggcctttctaatgaattaaataaacataataaaactagtagacaaataagttacttttattagaatcatcattcataactttagttgaaaaagagtaactgagtacctaatatatgtcaggcactcggcttaaagttgtcaatattaattaagaaagaaggtttcttagtcaagagcatgtattggtaacaaccatcaatatatttgcttctctgccaggcgcggtggctcacgcctgtaatcccagcactttgggaggccgaggcgggcggatcacgaggtcaggagatctagaccatcctaggtaacacggtgaaaccccatctctactaaagatacaaaaaattagccaggcgaggtggcgggcacctgtagtcccagctactccggaggctgaggaaggagaatggcgtgaacccggggggcggagcttgcagtgagccgagatcgcgccactgcactccagcctgggcaacagagcgagactccgtctcaaaaaaaaaaaatgtatatatatatatacacgtatatatatatacgtgtatatatatatatacgtgtatatatatatacgtgtatatatatatatacgtgtatatatatatacgtgtatatatatatatacgtgtatatatatacgtgtatatatatatatacgtgtatatatatatatacgtgtatatatatatatacgtgtatatatatatatacgtgtatatatatatatacgtgtatatatatatttgcttctctggaggaggaaggtggtcttgaactgggatgagctcttgagtggagcctacagtaatcatttgaggagggaagactggggtgatgcattctgataaatgacacctcacacttgtgttaccaggaaaaaaagatttcagagtctggaaaagctcccataattaaagagaattccttaggaagtagcttatgagagcgagatatatgccctgtaatggagctcccaggtacagctgtgttaagccttcatagatgagttctagaataggatgttgggtgcaatagataattatttgaaggcaaaggcaatggaggaataattccatgcatccctttaatttagaaaagcaataatgtaaggaaattagagtccctgtcctagttctaccacctactttgttaccctgaaaaaatgacttttttttttttttactagcttcaatgtcttgatctacaaaacgggtataatcacaaacatgtaaaaacagattgtggtttagccccgaagtgccaaagtgctcctgaagctgccccggataaaaattctgataatcgagtccaatgtgggtggtaagagcattttaaacgggaaagaaacactttcttaggtaaataattgcaaggtatttaattacttatgttccacaaggaaaaaagatagcttcagcatgaaagggagacctctgagaaagtagagcagacctccaaacagatttgctaagaaaaaacaatgtgtccctgggagtagatctctagaagtttcaaaacattggatgtttctttctcccttttactattctctatttaattaaattcaatatagcacaattatttagtatttgctataaggaaggtactcttttagaaactctgtgccaacttccctcattcagaattactgtaaaatttatcttcctactcaaactggatcttagtaaggagtacaaaatgcaaaattctttgatgtgttgtagatttaatgcataattatagttaagtcacaattttcaaccttagtttccaaaatgttaactgggtatagaattagcagtacctattatcatcttcccaagaatattttgaaggaaacttaaaagtatattacttattatatagcaggtatcttttctaaattatgtgcaaaacaaatgtgattttaaatctatgtgagaaatttactattaaaatatctctagggtgtactcttgtgaaatgagggatctttgcagctcatggagacaattattccttaacttttttgtaaattttttttatgttgataaattacttgtggcgaattacttatatctatttgtagctatttgatcagctgagaacactaaaagattagcacagtatgtatgtatgtacatactatatgcacatatttggtatatatgtatattatgtacagcacagatattgagaattgacctcatcctgaggaacaaaataagtaataaacataattagaggagataggcagaaagaaatagagataataaaaaattcattaaaagttgccaagaaaataatggctatcattttttcaacccccagctatgtgacaagcatcaagcagttttatatgtgtaatttataattccacagctgtcccatgggatagagagtattattctttcttcataatgcagacaaaaaaaaaagctcagagtgcttaagtaataaggaaaagaaaagttcaaacttaaggttctcagttctgtttgagaggtcctcactctccctactacaatatgttttcctaatgataatttatccagtacattgtggacaactcatcaatgcttccttttctttgaggactctgctttagagcaagttgcaaaacctgggccaagattactgactctccattttcagaaactactgtgcttctatgattattcttcagtagtaatacatagtgatagaaatttggaactcaaagacacgcaaagtcccctgaaagtcacttaattcagtcccctcatttttgaatgatttgctttcctgattaaagctcacatatttaaaaataattaaggaattagctgcacatagaaaatgaaaaactaccccacacaaagcaataattattaacattttgaaatacttcttcctttttctttgcttaatctttacattgtgaatattatgcaattttgaaatgagctttttctaacttattacagcattttccaaacttctccaaaaacacttcataaatgctacttttaacagctgtaacacatcccactggaaaaagttataatttacttaatgatgtccctgttgtcagatatttaaggtgtttctaattgctactaaaaatagtattgcagtttttcaaagggtagaaggctcttgaatatattgtaaaactgctttttaaaaagccaccattttgatttatagataacaaaatggaggagtggtacatattgaggaactatgtagctatggttactcagctaataaatgtttgctgtagctgttgaagtcagttcctctctccattctccattctttctatggccacagctacttaattggacttaatgtgggtggcgggaaatgccaaccatatccttaatcataattttggaaatgacacatatgcaagtgggacaagcctagtctttaaactcagatagaactgacctctcatttaccagctctgtgggcttgaataagttatgtaaactttctgagcctttatttcctcacctcacaaagtggggaaaataaaatttaccccataaggttactgtgaggaataaagaatgtcagatatataaaaatccgggtgcacggtaggctctcaataaatggtgctttttaattttttgagaatatatatgacatttactatgaagttattcatttaggtcatcaaaataaatgtccttttgagtaatttttcattaattcctgtacattctagcaggtatctgtggtttcaacaagcaaattctcttctaaaaggtatgatgctacctctgaattctaaccctctgaaaaaacagcttctttgtaacaaagtttcccatgttatgacagaagaatttccaaaaaaaacccctcattaaatcatgagaagtgacactggagagtgtcactgtgttcagtgtttcctctgcattcattgctacccacctccactgcttggagtgcatttcaagtggaaggtacaatggagaaactacagttaaaactgaggaattgcaaaatttactttctctaaactacttttcctaacctccctctttttcattcttgataggacagattttcccctctcaaatatgctgtcctttttaattgctaacacaagcatatataatatctcatttctgcttatgctgctgatgtacgcatgtgctgttagagttctgagataatgttgaaagtcacagataaataataatgtattcggttttcactactgggagtggaggtttaatattcatgtttcactgataggtttaacactggtttaggatactctaatttcaggggcaccatctacatggaagcttttctcatcaaatggagaatggttgtcccccttttgcccctctaaaaaactatcctttaaaagtagcttgctttcttgggactctatagtcttactgttatgttcaattttctgtgtcctttcctgaacttaggagagttctgaagccaatctcccctctgatattattaaagattgcaagaaaattttcttgtgttagaccattcttccccaaatcacattcttcacctgatatgtgattcaactccactcaagggaatcaacttcttgatgaaatataatcaactttgattaaataagtaactgcttcctattcatgttttagcacttttcacatacagatttaacatttccactcatgttttcctttgagtctctgggttgagggtagagttttatcttttgtgttgttacggttaagatgataacttccataattaatttttcaaaaaggcaatgataacagaatatactgtatgtttactctgtactgatttaaaacccccaagtcaatttagccttaagaaagcatactatttagtgtattttgtgttactctttgatatcctacttctaaataacttcttcacatttgcataaaaataactgaaggtcaccctccaaggtaggcattttgaatgtcgtaaggatgacagtaatgtttctgcctatcattcctttcatcacacagacacacacacacataattttttatactaaagaatttttagaaaattgttttggtcaaaactgttgattcagatattcagactgtgacaaccattctgaaggaattaaaaatccagttatcttcagtgattcctttggaaattattattctgggttattagatagatagactaataactttttttccagttttctaaagctaccttgatttcctgtcttagaaaacaggggttcacaaacactgcttaatatctctttaatgattatgaatactagaatagcttagaggtataccctaaaggccaccatatagatcttctgtacagatgtgaatttaaaagtatgcaaatttacactgattttacctaacaccttggaacataccaggagtctgaatacataaatatatttttattatgatatgtatatttttaaagtggagtttagaaatttctagctacactgaaaaattataatgaagtaggtatttactgtaaaaaactaatgtgctttcttaagggcatagtttaattaggcactataataactgacaaacgtacactgtgtaaaagtttacagtgactcttcacacatactattttatctacctcttattacgggactaccatagggtctcaggtttacagatgagaacatgaaagcactgagagtttctcatacttcattctggtaccatgacagctaataagcaaaagaaatagaatctgctcacaggtcatgtgaatgctaaagaaagtaatctttcaactgcacgcttcaagtggttcctgtgctggtgaataggtatcccacttattgcttttaaattaaggtaggaataagtaatttatatgtacagtcatatgagaatttttcactggttttattttggtcaaaaaataaatttttgaaagatgttaacctcctttcaaccaataaatatttactgtgacttatacggctgatgcttgagtatagtagaggcccaaaggggttaagcgactttcaaaataatagttaactaaaagagatggaactgaaaccatatacatatttatagcactccatgggcaaccaagttcaactatatatgaattactagtcaatgacttttggtaggccatgcaacctatctgagcctcagtctccagatctacaaaatgaaaaaatgaaacattgaaaacataaggatattgtgataattaaattagataatggaagttgaagtgtcctattattgttaagctcctcctaattgtttttgaagaaaacaataactttaccatgtgatttaggaagaaagtttcaataagcttttaaaaattaaatgttaaatataatatattcaacttcaactattcagcatgtaaattgcatggagtaaaattcaaagtgtccgatgttggacatttaacaattagatgttcaactgggggagtcattgttctctagacagctgctgtttctttaaattgggtgagagagttatacaattgctgagtcagatgatctggcagcctgaaagagaatgagagcaagaaaatggtggcactcgagaaaagaaagcaaaacaagctttttcctaatacatcagcaaagtcactggtgtaatattagacaaattttagcttaaaagcagaaaaatgatcatttgaaaggcatgatattttagtttttcttataattgttactttttagcttacatttttcatctatatttccccccccatcactgtgcttttacagagacataaagacccatcattttgtccataaatgctttattctgttatggctacattttcctgcaatcttgccctgatcttagataagcataagttaaacctgtgaaacacttgtgctttgatttttcttttttacataattttaggttgtcatgtttattacgagcctggtctggatcataaaatgaaagaaaccccttattacaacacacacacacacacacacacacacacacacacacagagagagagagagagagagagagatccattcatcctgcacgaacagaaagaagtgtatatagtgttttaaaaagacaacgtatcttatatagcttatgtggaaattttctgtctggttctgtaagctttaaaacacaaatatatcttgttatatttttttctctcaaactatgttctgactgtaaaaatgtggtatctacaagacattcttttccaattcatacaaagggtcacataataataaagggtctccttcatttggtgaaataactcctccactgattactcagactctcctccctgggatccagtaaactgactctaaacttaaaatcttacctaaaatcctggacctcaattcaaagataaagaagcagaaataaggtttaaaaagtaaaattggtcatatttgtcaaattgtgtcccaatgggccacttgtattagtatctccttcaagtgtttatttaaaatgcagatttctgggacccacagcaaatctgaatcaaattttctgaacgtgaaccccagaaatatgtatttttaaaggcagcccaggtaataatgctgttgttaacctttgccatacttttaaaatttctagttactcacataattcaattaagaaagcagaggcttttttatttacgttaccttgattgtacgattttattagtttcaatttgcttaagagattacatgtctttgttcatgtaattctgaacctctataaaacttttctctcttaaaaaaatcctactgccttcacaaccatttaaataatttatgatattttattttgaaggtgaaagagaaaactgagaaatagttgaattaaaaaatcctttgtgataacatgtttatattttcatgaacaaagccaataagtcataaaaattaaaaatcaacatactattttttgaaaggacctctgatgctttgggaatttcaatcctgtagttgatggctttcacttttttttcccttttattacttctttttgattgtagagttctgcccaaatgaaaccatcattccagggctcatgaattaaatgaatgcactgagagacactgacaagcactgagaatttcttcaaccaccctttttaaaaaacaaatgctaattggacataaatatgagaacaatagacattggggactactagatggaggagaaagggaatgagcgagggctgaaatactacctactgtgggtactgtgctcactacttgagtgacagattcagtcgtactcgaaacctcagcatggtgcaatatacctttgtaattaacctgcacatgtgccctctcctcctaaataaaagttgaaaaaaaatctacgaggcactatatttttaaaaataccactatgtacaaggcactgtgctatatctggaactacaaatattagttaaatagtccaagattcagtgggttcagagactctaagtatttgccattccctttagatggaaacgttctttggtccaccaagccctatcgttctgctctttggaaattctccctcactttcttcataatgccgtccttgactaactctcctctagcaatactattggttttgtatgtgatttaaaatcattcctgtaatttcttctgtttatatggcttcgtacaagagattcacattcaacaaatagaaaaaaaacgctattgacatttggtagcttcgacaattgtaaacacatgtgggtttgctgaatacacattaaaatagcatgaattaggatatggtaaatctgttgcggtcccaagttggtgggtttttctaggaagagtcagaccctttaaaaggaccttttatcatctaccaaacaaatccttcatttattaattcccaaggttttctccatcggttggcttactgtcatggaaattgatcttgttttaatagctacttacttttttttattctaatcaatgatttcatttgaaaagaaaattttcaaacatggggaaagctgcaatataagaagaaaacaatggagagacatcgtcactggaaaaatactacgggccactctctataccatcctgcacccccagatggagaaactgagggaagtcgtggcctttcaacactcttgggtctccatctggcttggaagggaacgaaatggctgtcaagagtctcagaagcgcactttccccgtggttcctccgggtaaccctgactcacttttcatctacccatcccctccaaaacaaggcctagccagttccaagctggagaggtgacccagagttgccttctgtcatgtcctgcctttcgtctcgagtccactaaccccactcagactctgtctgctcccacccccaccgcggccagtgaaatcccaatcgtcttccacgtggaaccccaggtccgcagttatgataacggatcacatcgctcctgcggaaagtgcgcgcggtggagtgataattggacctagcgtctaaattcttgttggaggacctcgttccagctgccagttaagcctctgggatccgcagcgtctctaggaattgagagagtggggaagttaggatccaggaggaggatggtgggggctgaggagtggaggagcagcgtgcatctcatctcttgtcgccgggcgggcgctctttcgggtccagggcccttgcacccccagcgtggctccggaggcggcgagacctgcctgaaattgattggaggggactagagtgtgcttgtggggtggggtagtgggggcggagagaagagatcccaagaagggcgccaagtgctgtgaccagaggcctaacacgaggcaccttggaaacaggtatagctacggatttatgggttttaaaatggaacgtcttggtgaatggacatagcgtgcatttcacagtctgacgtcacagccctcgcaggttttcccagaccttaaagccacgttctcgtgtatgacacttaaacaactcagtttccttgtctttcctccctccctacccatctaagggtagagaagctcttagttcatccactgtgtaggactgttaccgtgtgtcaaaggctttggaaatgtatattttactgatgatggtcatagcactttggaaaactcaaaagtgaaacgaagaaaataaatatcaccaaactttttcccaacccctctcatcctgcggaaaccattataactaatttggtgagagagagagagagagagagagagagagagagagagagaaactgtttactgtttggaatcttgctttaaaaaaacctgactttataatgcaatcatttaacagtctatgaaatattcttcagatacctgatgatccagaatgtaactgtaccataatttaacactttattgctagaattttatgcagtttttgatttcttgctactacttatccatctgtattaatctttgtcagaacctttctttccttaggatgatgcctgaatataaaatagctgaatgaaagtggatgggttcattttaaaatacaaaattgtttttcttgatggtgaagtgtttaagaggtggattaatctcattgggcaacaaatagagaagatattagtagttaggtatatgagaatcagaattcagataatttgtcttaaaaattcatattcaatgtaaaaattttatatttagaaaatgaaactgtacccattgtttatataacttaaactgccaaaataaagcaccacaaaaactttttatcacgttggtttttgtatcaggctgggctttgcagcagatggaggagctagggcaagcttgtccaacctgtgggcccgagggtcacatgcagcccaggatggttttgaatgctgcccaacacaaattcatacactttcttaaagtatcatgagtttttttttttttttaagctcatcagctattgttagtgttagtgtatttaatgtgtgtcccaagacaattcttcttcttcctatgtggcccagggaaggtaaaagattgaacacccctggcctacagtgttctactatgaagtttcagttttagttcggcctagaatgttttagtacagaaggcaagtgagattttctctgtttctccaaggacttttgaaaaagtgtaaaagcactgggcccactgttgaaccttgctataaaaaagtatttttgataccatttgtatcactttagtaataggagtttttcatatgttgggaaaatggtttagcttaactctatcatggtagttgatagtgatgaactaacgtggaataatagatctgtaaaccatcatagacggtaataggctatgttgttgctaccttaggatcataatggactttctaaaattcaagagtactcaaagaagtaaaatgaatataagtcttgatttctgaaagggctatggttcacttggaacacaatacaaactgtgaatcatgtacacatggggaataatggtttatactaactgcacagtgcttaccttgagaggactctgtgctattaaagaaaaaaataacctgagccttctgaagtagctataaacaaatgaatatttaacttcataataaaaatatgactattttgtaaatgcaccaaggtagaagtaacaaatcaactatggcaatttttcaggtttctgtggttaagaaactggtaacgtggaattttagtatatgtatttccaatcatataaaaataaaaagtcataataaacatatttgcagaaacttaaaaaaagttaaaataacatcttatttgcaatgatattaaataattcatacaagtaatttttagcacttgtgcctctcaaggaattgtatgaatcctaacataattagtatccatatatattcccaaatcaatatagccatgggcataaaatatattaatgtgaaatatataattacatatcattataattaacaccgctagattttatattatgtatatcattttacatatgaaattggaaaattgcatatatttcaagacattctatccaagctgtgttctatcttgagaaacttcctgaagattgcgcttttcacatacgtcctgaaaattgatttatacctaaataacaaaaaatgatctatttcaatgaacctatcatttaaatatttttgcatttcatgcatatacattaacatactataaaatattttctctaacttaaaatcaccacaatgttatgttttataggcctaaactaaaaaatacataattatggcatttatatacattgacatgttctactttgttactacagattttcagaggcaacttaataatttaaacaaaatgattttatatagaataatattaactagagtaataaatatttttatatagacaataatattaagaactatattcatacagttaccggtcacagtggctaaacttttgctgatacggataaaccactgttaaaaaaaacaacaaccagggtcttgtcaatgtttcaaaatgaattaaaatcaaatccagcaacaggccctgaaatcctttataagctcctttgactaaattaaaaaaattaacttgcataatatgaaaagtaaaaaataaaatgtgcatttatcctatagattataaatttttgctaatagaaattgagacactaaattaaacactgatagttttaacaggtttatatttccatgtcaaagagacaattaacattgcagtaaaaaaataattacccctccgctggcctttgctttttgaagctatatattcctggcgaagcataccacaaggacggtcataaaagtgaagcctcattaaattacttttagacttattacacaagttttaattagcattgtacatattttaactgtacatatattctttcagttttcctggttataggaaattacactggctgtgtcaacatttgtcaatgtgaggacaaaactaccttggattctgtttttcaagaagtaggcctcatttttaaactgtgctaactgtcgtctgagatgactaaaatactatcagttgggatttctcaggaacagttctacagttctgtcgtttgctaaacatacgagcattgtcccgagcagtttcaatcactcaggccgccggacctctacctctaactcacaaagaaagcccatttccctgttggctgcaaaactcccccaagaagcaagtgcttgctcctcgcagcagtaactgatcctacgatccttgttagcatttcaggaagtcgctgcctgcgtgccccgtatctcacgggtcctccactctcctggaaggtgggagagggtgaccccgccgggaggctggggagaaaaaaggccgcctccagaaaacttagatggttagcaataattctccccaaggagaaagaaagtgtgcttgaaatacacctttcctactgtgtgtgtgtgtgtgtgtgtgtgtgtgtgtgtgtgtgtgtgtgtgtcttagtcattcccacccaggatattcgggactcactgacttctgaggtgggtttagaagctctgttcgcctcagtttcccacgattgaggggctgtgtgaagggaggtccaggttcaatggtactgcgagaaccacatgtctaagtcgttgtaacccgaatggggaagcctccaccggcggttatctcctcctcctcctagcctgggctagagacgaattatctgtttacgaaatcacaccaaacaaaacaagtgccgaatgcgccccggacttttcgagggcctttcctacctggtcttctaggaagcggctgctgccctagacgctggctcctcagtagcatcagcacgagggccacagcggcgggcgcccctggcgctgcccactcccccgtgagccgcgggatgtgaaccacgaaaaccctcactcgcggcgggccgcacgcgcgccgaatccggagggtcaccaagaacctgcgcaccatgttctcgccgcctccagggccgagctcggcagccgctgcgccgccctttggcaccagaggtgagcagcgccactcctgcccccttaactgcagactgggacccacgcaccgccccctgcccatctccgccccgcaggcgcgcacccgccttccctgagcgcgcccgccccccaccttcacccccacccccaccccacccccactcccacccggacctccaagatctcggaacggctctgagccctgcgcacgcgggaagggctgccggaggcgcccgtagggaggcgcgcgcgcgggcggctcagggcccgcgttcctctccctcccgcctaccgccactttcccgccctgtgtgcgcccccacccccaccaccatcttcccaccctcagcgcgggcgccccgcggtgacggcccaggggccggacgcctggaacgcaactccaggcagctcgccccctagctacatccgtcacctgacacggccctaccaggaacagccgcgctcccgcggattctggtgctgctcgcgtccccgctcccctattccccttattttattcctggctcccctcgtcgaaagtcttccattcttcaaactagattatttaaaaatgaaaaaggaagaaaggaaagcgaggtcatctcattgctctatccgccaatcaggaggctgaatgtcagttttgaactaaaagccgctccgctcctcttctagatttggaaaacaagcgaaattaaactaaaccgctgcacgcctctgacgcgacatctggacacggcgcggcgctggcgctgccggagctgtcgacccggcctggcgccggactaggtaggtggagtcgcacccgggggtcccagctgggtccgggcgcccattcccctcccagctgcccgcgtcgccgagggcgcctggctgggacaagcaccgagtcctttgtgtctagcccatttttattttcggttttaaccttcacgacagccgcggagcatctgagcgcttcttcctctttcctcttcccccgcgctcccctcccctgctggccgctcccctcctgtcgccgcgtcctcgcgtagaatggttgtcttggcgaccgttggccgctgccgcctccacgctctgccccgcgcccagacaccccgactccccttgatcccgccgcctgactcctcggcgtacgttctctctccggtctccccctccatgtcccctcctccccttttcttccacatcaccgatcctttctggactctctcccttcctcctttccagctgggagacaggaaaagcggtcctgtttgggaacagtaaaagcagggcaaggaaaggaaggagcggcagaaaggaggggtgagtcgaggacacaggggcagccggagaatgcggaggagccgggtcctgagcgcggtctaagcgaggctcggctctcgtccaggaactcggacgcgggctcgccggctctccgcgcgcgggaagtcgagcccaggacgccgccttcaggccggcgcgctgacccggtgccccgacccggagcctgcggtctgcctggatccgtcctaaacctcgcgggctggacccgcggcctgagtgggtgggtgtgtgccagaggattcgggactaggcccagctccgggaacctggaaatgtggcccgcttctcagtggcttcctgttcatgcgcttgggcctagtggcctagttgaagaagtggaaccacagcgtgagccgacagggccttacagatcagacgtcaagccccccagaccttacaggggaggaaagtgaggcctgcactggccgagccacccacttaaggcggtgcggtagcctagaggagcggcagacttctctttccccatcccccgccccatcacttgacgttgctgccggacctcggtacaaacccaagacaaaacggggccctttggaaaaagtgagatttagcgatcactcttacgtagccactctaaatatctatctagatatttacaaatgcacctccccggtaggtagatttcactcagaatttacccaacaccgtgctttgtgctggggccacatgccacctttctgtctagtatggctgctctttctccctcttcgcaaatatagctctttttccttcaggtctcttctgaagtaagtagcccttcctcagaaatgcttcccttttcaggcaccctcataccaccgtgatttttttctttatagcacttaggacgaagagattattttacttatgtacttgtttacttgtttgttgtgtagaatgtcagctctatgggaaccagatccttttatgggtcttcctctgcacctatgccacgcccccagcattcccctcctaccaccaccttcagccggcctccgcctctgtaggggggcattaggttttctgtcccacagaggaagggcgctttagaaagggttagttcatcctggaagaaaaacgatgtcggatgccagcatagtgtcatttaaagatactggaggaatggagtgggagcggtgagggtttcttgggcctagacaatgtaactagttgttgcaataaagcatggtggggaaaggagaaaaggcacgtattaaacatcttttgaagtcgctatctatatcagtcagttctccagggaaacagaacccattgtgtgtgtgtgcgtgccagtaccacacatatgtatatgtatatacacaccgtcatggggttgcttaacaacagggatacattctcagacatgtatctttaggcgatttcattgttgtgcaaacatcatatacaaacctaggtggtatagtctattatacatctaggctgtatggtatgggctattgctcctaggctgcaaacctttacaacatgttactatactgaatactgtagataattgtaacaaaatgtagttttatatctaaacacatctaaacatagaaaaggtagtatgttgtgctacaactttaggacagctatgacatcactaggggataggaatttttcacatccattataatcttatgggacaccaccaatatgtgactgtggttgactgaagcatcgttatccagcacatgactctgtgtgtgtatacaattttatatatacgtacattatatgtctacacacacatatgtgggggagagaaagagagggagggagagagagagagagagagagagaaagagaaagagagaaaatacttattttaaggaattgtctcagaaaatggtgggggttgacaaattggagacccagggaagagttgttgttgcaagacttgaatccaaaggcaatctggaagcagaatttcttcttccttgagggacctcagtcatttctcttaagctcttcaactgcttggatgaggaccacccatattattgaggataatctgctttttcaagtctactgacttaaatgttaatcatatctaaaaaatacctccacagcaatatttagactggtgtttgactcaaacactgggtaccacagcctagccaagttgacataccaaattaactgtcacattatcccgtcatgcctgaggggttctctgaccctcagttttctgaggatcaaatttaaattgagggatctatctttgtttattggagccatatagctcaaagtataatcattttctctccacaggaactagacctagggataagggtaattgcttatttcagaggaatgccatctgaataaaaggataattatatagtaagctctctgttcaaaaaatgtaaatattaaagtttgaacatctaaattccatcttggtttcccccactgccgctgcccaatacctgttctctttcagttgcagtatgcaggggaattctaagtttaatattagtctcagcaaaatacaatggtgaagatgactctttctagcataacaatgggtatgtggtattccaaatacttttggaatgcggagtgactattggctatgtgctcttcaaaaaattaataatgaagaactgagcatgtaatttcacttatattacttattttatcctcacagtggcctttcaaaattgggattattactcctgttttacaggtggaaagaatgaggcctagaaaggctcaaatcttgaacacttcatggccagcaagagccagggctggaatcatcaggcaggcctttgggttacaagccttgtgccttttctgttgtcccaaaggccagggtcaatagggagtgagttatctgtgggtcacttatgcagacagaatcactgaatattggaagtttttggggttctcttccactggcctaaaaacctgagttaattgagttttttttaacaggggtaaataattttctgttttagatcagcaaattcattccataggcagggataggggagaaaaatcttactgaatatcccttgtcttgttctcctcctccccaaacttaatgtcctatgacactagctttatcccttaggtaactcttgattatccaaatttcatgagaaactttcctaacattgcacatgctcaaactcaaaaccccaaagtcataagaaaaaagataacataagcaagaataaaaaacaattatttgatcatatatgtcaaaagattaattactagactatataaataaatacataatccagtaaaacaacaatccaataaaaaaggcaaaggatataatagtttatagtagaatatgtgcaaatagtaaaaaataaaaagataatcttactcattaataaatgtaaacagaaacaatggcatataaccacaagtgtggcaaaaagaaaaaagactactttgacaaagttgtcaggaaacaatcactcttactattacaacttggtgtaattgttttgaaaggcagcattacaatatctagtcaaaactgtatgagaatataggtaccctttgactcagctattccactattttaagtatgtaaagacacacacaaataatgtatggaaatatatatacacatatatactatatagtatatatagttcatatgtatgttatatgtttgtgtatatatctatatacttatatacaccctttgactcagcaattctattcctataactcatgtatgtaacatatataatacatatctttatatacacatatgtacacacatatctgtaagtatgggaagatgtatacacatgtacacatatatatacatacatatgtatatatgtattttatgtatggatacatatgtatatatggatagattttacacctacagacacatttagatatgtaacttcagctaaagcaattcactcctatataaattgctacagataacttgtataagtatgcagaaatgtttctttatagcagtgtgtattagcaaacaaagtgcaagaaagagaaaaatgattgacatgcttgtgaggagactttttttgttgttgttgttgttagggctcattcataaaataataaaactgtgcatccataaacaataatgaagcacatctatatgcactgacaatggaagttgtcaaagatctattgctaattaaagaaagcaagtgacagaatagtatgatcccattcatgttttccaaatatgcatgctgggggagagatgtttgcaattatatgtacttatatttctggaaggataattaaatatttgtaatagtggttacctttgggtagtaagaatgagggtgggaaaaatttcagatttttgcttactactttttgctttctggactgtttgaaagtttaccatgagcaagaattattaaataacaaccacaggaatattggggctcaaacctagagattctaattttgtagacctggagctgatcaacaagtctaaatgttaaaacatcctcacgggtgattctgacatggagccaggattgagaaacaattttctgaaatggaaggggttttaaacttgttgtcctcaaatgactactgaggcaaacaccattcttatagacataagacatacttgggagcaaatgtataataaagtggtatgcttccctagaaaggggacgaccttaaatctttctgtttatggtggtatttaaacatattaaaaactactaattttggaatagtcttactgtgataagtctaactatcaaaggcagtccagagattagcaaataatagaggatgatcaaatgtttttcagaaaatattataggtggcactttggcaggagattctgagaatggtgagagggtgcctctgtgccctaggaaaggtgatagagcttagaaactcagaactcagatggaatgaggagccatgccatatacatctttacaacagtcaccctctagaagaaaactctgtgttgacaataatctgctgacttgtctgtgggtttttgaacagaataaactgtttcttcttttatgtttgtgtattattgcttataaatatattctaaaatatataataacaaacaataacagtacttgcagcttaattaaagaaaaaatgcaagtatcttatttatactaagagaagagagaaacccgaagaacaatggattatccttacatatttggtttgggattacattgagagctacctaaataccagacactcattcttggtcctgactcctactctgttatccatagctcagtacctagtatctggcgcagaaagaagtggaatggaattatcagggagacccagtttttagccaagactaaaaggttttagccaaggggatggaagaatttgtgcatagatagacggcagatgggaattcgtttaaaatggaatggagacccagaggtcacataagacagggttcagaggaagtagccccaacaacatcataatagagaacattgataatgagaggatagatagattatgcatttggggaggaggccaaatatgagaaataagacatggtttacttactgtaattggtcttaaagttttgagtggaactctgttgtaaaatattttctgtgccagagctgactccatatatctactggaagtctaatgccaggggcttctgagtgtgaagtggattaataggtgtttggggtcctttgtaaacttctagtgtaatgtgaatagctgtgaggtagtcagtgtgtcatcttaatacattgttcttagttctttttccagcaaactcttttgttttacatttagttcacaccacaaattagtaagtcaggcttggtgctttttgacccatacattaattttcattactgtgcttaatatacaatccatgccaattacatattattaattagtggcactagtattagttcatattttcttttattatgtaattaatagggcctatatgtgaaagttactgtgtttctgtaaaatgaagtattctttttccttacgcaaggaatgacattaaaatcttctgagtagggaatttaagaggcaagaaaggagtaatttcatttggatagctgaaattgagaaacgttttatagaaacttttcaggtatgaaggatagtagtagagatgttacatgagttagcactcatatattgaattagttaaggaaccaatgtgggaatctaggtcttctatcttccagtcaagtccttgtttcacttttcttcattccctctttctttcctgtcgttataagtagaataggaaaatattgaaagtattgaggctcaactgttgttgcccctttaagtaatttctaaaattaaaattgtcttattttcatatatgtgtgattgtgtatctaggtatctctttgtagcttagtaattgaacactgtgaactacaccaacctaagcattattctccaagttttcatcaaataactagacagtttctgttaatactgaaaatctagtaaacgtgtcagaatttggttatgattagttgctgacataaaacatgagggcagacctcactgtactttagaagatactggctttcacatttgccccagtaggtagttcacatgagtgcttcttcagataatgtctctaagttttgcatatcattagttctacttgctccacttttgatagagtggcaatgtattgaacattgtaaaaattatgctctatgatttaaaaaatccatctctggtaaagcataaaatgagtatatgttttactgtttaaaataattgaggggtaattatagaatcagcaaaaagaaaaaaaaaccctactgactattacatatcaatgcacacagtgtgttaatattttcaaaaaagggagggcaatctcagtgtaagtgtaaatgaaattagtttttgtatatatttgctgaagatcagttacctagcttcatatgataaattatttggtgctggtcacaatattgtgcttgccatattagggaaataaaatatcatgaaagtattcctaagtatacattttcccagaggcgtttggggttttatcagtctcgagctctcctcttgaaactgtttcattccttagttatgaaattactaattttaaccatttaaggcataggaaattttacatagattttgctttaacagcaaaacaccctttaaaaaattcatccacttaggtgaaaaataaaagataaaaatgaagccaaatgaatgttattaaatttataaatttatttaactttccagatcttcttggaataaatgtcaggtagtagaatttgtacaaaccttggtaatgtcttaggtttagatacgaacttaacaggtatatttaattttctgtattccacaatggagctagaagcaggactcatgaaaatagtaactatatgttttgcatgtatccttcaaagtgaaatccttaacaaatttaacagtatatattaggctgctgatgaaacagctaaacctgtctgccaggtggcttcgaaaatggaattaatttttacatggcattgataagttactatttcaatacaaccaggtggtaattgatacccaataatgtttgaggtttgctttaaataaaaaaaactaacaaaacaaacaaaaaaaacagtgtaatatagtactgtgggatccacaataacattttctttagtttcccttaatatcaggttgtcattaggaaagattccacaagttatttaaaccagaaatgaagtaacatgtttcatatctatttcaagggataatttttcatgacccagtataatgcaactagcaaatttaaacatcttggaatttaagatatagaggtcaaattaagggattttataaaccaaatgggagattttaaagtatcaactgacttcttttatatagaatgttttctaataattgtaaaatactgtaactttaaaaatattattcttgtagcctctaatgattgagtgcttaagtgataactagaaatatattttctgtccctgtgcttcagtttgaaaatggaggttccattatctttgttccaaaaatttgggtttttataggtgtgttggggggggttattctccatattgttgacattttaaaatagttttcaaacaaaccgtttatatttactagaagttagagaaagaaaagccaccttaggagcttacaagggagatcattgtgtatttctgcttttttttaaaaaaagttatcttcatgtgtatcattcatgattttggaggacaagctggtgcaatgggaagaaaagcaagacaaccataatcagctgtggaactagatgcacttctttgtgcatccatggaatgaatatcttgtaacctttggcaagttacttgatatttctttgcctcattgtcctcatctgggaaacaatacctatctctcaggtttaaatattaaattaacaaatatattttaatgcatacctggtacagattatgtgtcaataaacatatcctttccccaataacatatgctctgattctcaactaactttccccagtaatatgttcattttgggaataggaattggtagagaagtaaagatttgtgtattcaactcaaatgtactccttcttataagtctccactctcaaatgacttgtttctgttccttttttctcttttaaatgtgtatctggtagaatgagcatttagaagcataatacatgtatacactttgtgtttaattttctatggcataagtaagcagtttttatgaattgctggtattgcttatgagcaattattacaaacattgagagaagggaacccctgtgaacctttaacatttctcaggagttagtggtaaacccatgaacatgtatttttaaaccaaattacccacctcttggagttcaatctctgttaattctttattaaagtagtgaagtatcagttgttccaatgatataatgatcaagcaaccctggaaattaaatcccaaagcagtgcacctttagtttgttcagtgatagtaggacatcccacgagccatcatatattttcaagtttttatactcaatctactttttcagcaatcttttgggaactatcccaagataatttactgcataagtgcatctatcttctaaaagacatttggaatatttcttagtctgacctctgcaccctgagacactctataaaggaaacaatcagaaaaatttaacaaagaaataaataggttaagaagaaagcaatctaggcgtttgcactgagtttgcaacagtgccattgctacatttaagagctgtagttcttcctcacattttaactgagagccactagttatgttacttaaaatctccccattaaataagacagttgctgaacaactaaaaagtacaaaatatcacaaaatcaaaaagtagcaagtcataaggggatttccgcatcctagcatgtgtgtgtgtgtgtgtgtgtgtgtgtgtgaaagaaaacgttacagttaaccgttacaattgctctcactccactccaccacctcatcctgtgtagtctgcctgcggaacccgcgggaatctctcctcagtgtagtaagagcaaaggccagcatcctgtgcaaaggtgctctgcagcgtcgtgatccagggattttagcatctgtcgtcgcttgcacatcctctcttacccctctgctatctggtggagttgggcgagggtctccagggcttccagagagtgtcgtttacgcatgtgacttgccatgcgctcaaactaaagcgccgccggggacttactgaagcccacctcggccctcctccactttgtcctcagtcttcaggttttcctttctgccgctagggcctaagttgtgggttcaccataactcctcagcagacattggagtgaacgcatcgactgccgtcacccaagtgctaatcactgccttctcccactcagcgctggagtgggagattcatccatcggaagattcgtagccaccaggtccagtcaaggatttcatatgcactttccctcagaaaaccctgaaaagcaaacgacccctggaatgtcacacactcctaaatatccctggaaatccgcttctctgtgtttcgcttcatggtgagtgtcgagggccagataagacaaagaaaaaaatgtatggaaggttattcccggtcggctcctccttcctgtgagtctcagacaggcttgcaggcttacaggctttccgccgctccccgttggcagccttcatcgaattaggtgggtgggggtgggaaattgggtaagaaaataaagtcgttgtgggcggctggggaacctggcgtcagtcccccgtggctgtgcgcaggtaccctgcaacgtcgcggtggccccgctcctcggccaagtccacgggcagacgaccccaggcatcgcgcacgtccagccgcgccccggcccggtgcagcaccaccagcgtgtccaggaagccctcccgggcagcatcatgcaccggtcgggtgagagtggcagggtctgcgcagttgggctccgcgccgtggagcagcagcagctccgccacgcgggcgctgcccatcatcatgacctgccagagagagcagagtggtcagagccagggtgggggcaggtatgggagatgccggccggggcaaggcaggtggagccatttaaagaaacacctaattgcaaagttttcacccagtgcagaggtgttcaggtctctgatgtctggtgtttcttcatttgctgatgcaatccactttcccaccccaccttcaggttatactcagtacaaattaaatgccattttattctctaaacgtgcagagacaagaaagttgatggtaaagtgatgatcatcattatggaaaaacaaatcttgatttccattggaacatgggaatctattttgttaaatgatttaggggcagagttaaatttattcggcttttaaagttttaaattatttgccttgctgacccctcctccataatccaggtctacaaatatttattaggtagtcaactactgtttgttagaagttgggagtaatggtttaggggagaaaataaacaactaagtttttttctttcttttttttttaatttatttagttctcatagcaaatcccgtgcggaaggcttttgtttgtcatgtgtctgagctcataactggcttgtagtgtgataatttgagccaaagttggagattagaagggaaaagtaaattaaatcatgcaaaatcttataaaattataataaatgatttttccttaacagttcatcattttaaatttagactataatatttttaatgtaatataaaactaactatatttgtatactacaggattttataatagctaagatttaaaaatgttaaacagtaaatattttgctatataaaaagagcttgggccaggcccagtggcttatgcctgtaatcccagcactttgggaggccatagcaggcagatcacctgaggtcaggagttcgagaccagcctggccaacatggtgaaatcccgtctctactacaaaaaataaaaaattagctgggcatggtggggcgtgcctgtagtcccagcaactcaggaggctgaggcaggagaatcgcttgcatcctggaagaggttgcagtgagctgagattgtgccactgcactccagcctgtccgacagagtgaggcctcatctcaaaaaaaataaaataaataaataaataaatagagcttggatgttagcagtcaatcaggatgatgcataacttagaaaaaatgatgttttgcaggagtaatcctgtagcagccatttgtgtacatgaacattatgaaaacatttgctgtcatatttaaagtcaattataagacaatttttggtaactaaatgtctaaaatcgagttatttgttatgggtttatgcactttaaaatataccatttaattgaaaggcagtatacttctcatgttttgttggcttgtttcattaatattagaaatgttcatttcatctcttaaaaaccgtgataagttatatctactagtgatgtaaggatattttacatagaaaaaaaggggaaaatagctgctgttagtatttcagaaaatggtgaattacatatataacttgtttttataattattaataaaattttaagtttttaagatgcactttacaatatttttgctcctttaaaaatccctcatttgttataccattattctaagaattcaaaagaaatgaacacttctttaaaatctatactattaacaagatcccttaatattagcttagttttagagggtgatagtgaggtgagtactgaatatgaccactagccaacggtaaagtacaaaagagttgtccgagattgtaaaagaaataaaaaatatcagtactaattaaagcaggattcgtacttaaacattgaataagtgtattttaacaatgaagataaagatgcattatttatgaagatcctttgccattcaaaaaggacctaacagttgctgcaggaatatttttgtaatctgggcactgagtatgataattaaagaatgagaaacctatagaactatatattttttctcttatgcatcactcataagacactgctaacataaaaggaactaagtactgtggttgaggaatcccgtctcattctcaattaacctctatgagaaaacaatacaacagatttcatatagtagcttagaagtttacattgattttttccatgtactatgattttgtagaattccttaaatccaatctagaatgcgtaacttatactttacttatctttatcgttgaaagcagacagacaagataatcttcttccctaaataagctttccttttctccttttctccccaattcagtctattccttgcatctctgatcatgagatggcagaacaaaaaccactaaaaaaagcttaaacagtgggtttttcaatgtctctctttaggatttttgctgggtaaaagcctgttttacgcgtggaatgcacacctccggccaacggagactcctgtacaaatctacatcggcgatctaggttccagccccgatccgccgaggccgcgccccgcgttcgcgcgccccctgccggcgaggccctggggccccagctacctggatcgcgcgcctcccgaaacggttgactccgttgggatccgcgccggcttccaggagctgtcgcaccttctccactagtccccgcgccgcggcgctggccagaccctcatcgctgccgcccccactgggcatgcccttgttctcctcgcgcattccgcagcccccagacgcgcagcggcccggataatccaccgttggccgtaaacttaacgacactcttcccttctttcccacgctgctccggcgcactctctccttcctaggagacctgggctcagcttcattaccctcccgtcgtccttctgcggcttggggccccgtgcagtggccgagcggccggtcgttagctccgggcttttcctggcgctcaagaaccagcgggcgcgcctggattgcttctgggaaaaagcgcctagcgcggacgcagccgagctcaaagccgctctggccgcagggtgcggacgcgtcgcggagtcctcactgccccgcctcgctctggcagagtggggagccagccggcaaagaattccgttttcagctgggccaaggggccggcgtctccccacccccttaggctccgccccctgtccgctgtgatcgccgggaggccaggcccgggccgacgcgtcacgagggcggggaagcctgcccaaagatgctaggacgcatgcgccagagactgggccagggagccgccaggaatgctggctgcactgctcgctggatgtccagtaaagccaaggctaatattttgggaatgttcaccactgccctcagctcctaatccccagtaggcggagcagaggatttctgttccttcagccagccagttggtttcactgtggagacgttggtggctcccttgtgaccgagagaaagtcattcaaaataactccgtgtttcttaagatgtctgaaagcgacagctctgcacctgtcatacaagttaaattcatccccaggcagtacttgggcttcacaagtttcataacttgtatcaaacttagcaattttctcttggatgtgtctttctgtttgaattagtcaaccataaaaatagagaaaaatcccgagaatcatgttttgcgtgtgctttttaattctttccatttttgcattatggatacaacccttaaaagagaaaaaaactagttcgagattgagagtggcaacctggcacacataagacaaaaaaaaattatactttaagaatctgagatcccagtttcatcatatttgtacagtaaatctttgtttgcactcttacctatttaaacccactttgtcaggtatcttatttttatttatcatgagtaataaaggaaatttatgcagtaataatgaaacatcataagagaggggtgtggtgctgggcttgtcattaaacaggctgaacctgtcattaaattctcttctgaagatttaaatgccaagtgctttttttccccttcctaatcttcctaggtgagtttgaatcaacatttattacttaaaatatttaaaacatttcagcggatgctacattggataggaagagaaccgcaagttatggatttgttgcctaaaaactttggtgaggaactgcataagtggacctctcctaaaagtgaacaatttttgtttacagaatcattttggttcggagtgctgaggaagacaaagtcttaacaggagggcaattgcttgtgtattgcaaaatgagagtcttcacatgttttttttaggataccttagctctgactcctcatcccccaaatccctgtagaattaaaaaaagctctttcttttaaaggcagtggaagtgccaccaccatggaagtgctggttagggctgaaaatctactgacagagcctcaacagagctgaaatccacctggacagggaagggaaccgggtagcattaataacaatttctttttctttcccatccaacccccatttcctagtcttcagtttcttaatttctctaccttttactcttatgctcttgttttgacctttgagtttctctgaaacttatcagaaaagttaggacaagatagtctgacccaattcttgagccattttcttaggtagtaaatatgtcagaaaaatgaaagctgtttggagttgataaggaaatggaagataatgtttttctttgagggggacataaagaatggtgatagggaaagaaccaatgactaagtaaaatgactgagaatcttgcacgaggcagatgtgtgagcttcgcgaagcaagttgactgaatgaaaaacaactttgggtagggaaaacgttgccgggggcattcgcgcttactagcaccacggacagcgctttgcttatactcaggcctgggtggtcctaaccagctccagacagaattctaaagcttcacacttgatcttccaaagccccttttctcccgtcaaatagaaaggacattatggaagctcaatgaatttctttgaaaaaccaacctgctcaacctggttttcaaatatgattggattttatctaatattctctgtataaagaatattatatagtctatatttagaagacgagaagagaaatcaaacttattgtgtactctgtacgaagtgctttacagctgttgtttcatttaatactcataaaactcctctgtggcatgtgtccatatttcaattttacagacaagccaaaaggatcagagaatttgagtgacttgtatactagctaatcattgttggaggtgggtataacttttgcgacttcagagtctttttaccctttatactacatagtgttttttttagcagctgtcatggtaggcttaactggaaaaaagtaataaactggcttataattatttttcagtctacactgtgttttccagatggctcacctcacagcacacccttaccagacttcaaagatgacatttcacatgtaatacaatagcacatttgtcttggacaatagagtgagattatgaaacattttacctctccttgaaacccagctgtctctagggtgaaacacaatctgttgttaatgctttaaacacatttaaaagatgaagtggatgggaacatagtgggcagctgaaacttggaattgtcagagccatgtcttttaataaggtggagaatttataattgagaagaaagaaagagaaagttaatggtaaattggcatagaattttggaggtcagtagaagggaatgagtggcatccattccaatgttgcacataactcagatcactagtaataatatttttatattctagttggtgaaattgtctgtatatgaccttgatatagaagtatgaacagatctgccatcctctttttcttcagcgaggcagccgagctgcagacacagagatgcagatctttgtgaagaccctcacgggcaagaccatcacccttgaggtcgagcccagtgacaccattgagaatgtcagtgcgaaaattcaagacaaggagggtatcccccctgacaagcagcgtctgatatttgccagcaaacagctggaggatggccgcactctctcagactacaacgtccagaaacagcccaccccgcacctggtgctgcacctgcgaggtggcattattgagccttcactcttccagctcacctagaaatacagctgaaacaagatgatctgccataagcgctatgctctcctgcacccctatgctgtcaattgccgcaagaagaagtgtggccacaccaacaacctgcaccccaagaaggtcaaataaggctcttccttcctcggagggcagcctcctgcccaggccccatggccctggagcctcaataaagtgtccctttcattgactggaaaaaaaaaaagtatgaatagaactggttgactggccaagagaaacagcgacctaaccttgccctcatttatgcacacttttgcatatgattaggactaagatagtgtttataagtgagaagagaaggaaattcataatcacttttggggctttttcaaattttttatgaacacaccttcccaccaagaggtttgattttctccattttatgagttgggtttattgctccgtgatccacagtatatccacttctatattcccatgtatttttcaagattaattaaatggtggacttgttcatcattttagtatccgtattagtttgctagggctgccataacagaataccacagactgagtagcttaaacaacaaatatttattttctcagagttttaacttctcctgaggcttctcttcttgacttgcacatggccatcctactgctgcctcttcacatagtcatccctctgtgcacacgtgcccctggatctcttgtgtgtgtccaaatttcctcctcttttgaggacaccagtcagattggattagggcccaccccaatggccttattttaacttagtcacttctttaagggctctatttccaaatacggtcaaattgtgaggtattgggcttaggactttaatataaaaatttagaggtgacagaatttaacccataacaacagcatcttaatttttacacattttacttttcatttctttttaaactgttattaataatttattcatttgaataaggattaaaataaggctaggatattgaaattggttgaaattgctacagtctcttgtatctctctctctctcttttttttcttataagggacaggtttcattcaccttgtcgaccaggctggagtgcaatactgtgagcaagggtcactgctgcctcgaattcctgggcttaagggatgctcctgcctcatcctccagagtagatgggactacaggtgttggccaccatgactggctaatatttttacttttttgaagagatgaagtcttgccatctggcccaggctggtcccgaactcctgggctcacacaattctttcacctcggccccccaaagtgctggattgcaagtgtgaaccactgcacctggcgtcttgtttcctcttaatctacagtttcccccttttgccttctttttttttctttcaatttatctattgcagaaattggctttatctgtagttttctaaagcttggattttgctgaatgcttctttataatgacacttaacatttttctttgtcatttgtatttctcataacttattatttaggcctagagtctgtatgtgattcaggtttgatatttgggcaaaagtatttaataagtgggattacgtactttcaccaagagacacataatatggttgtctctttctgtgattctagcagccatggataattatttcatagattattattttcttggggatggcaaaatggtgatattctaattttactattccttcatttactagctggaatgtctttttaaattatttatttatttatttattatttgagacagagtcttgcactgtcacccaggctggagtgcagtggtgtgatcatagctcactgcaacctgcaactcccaggctcaagtgatcctcccacctcagcttccccaatagctaggactacaggcacacatcacctggctaatttttaaattttttgtagagatgagggtcttgcttttttgcccaggctggtctctaactactgggctcagcctcctaagctcctcctgcttcagcctcccaaagtgttgggattacagacataagccactgtgcctggcctggaatatttctatatagaaagttctcttcattatctacttcattgctttcaggtatatgtaagaaagacaggataaaccactagattttgaaatgtatttataaattttcaaaataatgagttgagtcctagaatctttcttttattattattattattatactttaagttttagggtacatgtgcacaatgtgcaggttagttacataggtatacatgtgccatgctggtgtgctgcacccattaacttgtcatttagcattagatatatatcctaatgctatccctcccccctccccccaccccacaacagtccccagagtgtgatgttccccttcctgtgtccatgtgttctcattgttcaattcccatctatgagtgagaacatggcggtgtttggttttttgtccttgtgatagtttactgagaataatgatttccaatttcatccatgtccctacaaaggacatgaactcatcatttttatgactgcatagtattccatggtgtatatatgccacattttcttaatccagtctatcattgttggacatttgggttggttccaagtctttgctattgtgaatagtgccgcaataaacatacgtgtgcatgtgtctttatagcagcatgatttataatcctttgggtatatacccagtaatgggatggctgggtcaaatggtatttctagttctagatccctgagaaatcgccacactgacttccacaatggttgaactagtttacagtcccaccaacagtgtaaaagtgttcctatttctccacatcctctccagcacctgttttttcctgactttttttttctatttctagactctttattaagattcattttcctatgaaaaagtccattctttagtcagttctacactgtcttgattaaggtagctttataggaagtttttaaatcaggtaatgtaacccctccaaattcatcctcccttttcgaaattgtttggtcattctgaatcctttactttttaatataaatttaaaaattatcttgccaaataatcttgtttgaattttaattgggattgtgtggaatttatagatcaatttggggaagactgtcatctaaaaatattgaatcttcaattcattaacatgaatttattcccccatttatttttatttatttatttatttttctttattattattatactttaagttttagggtacatgtgcacaatgtgcaggttagttacatatgtattcatgtgccatgctggtgcgctgcaccgactaactcatcatctaccattagtttcctgactgtttaatgattgccattctaactggtgtgagatggtatctcattgtggttttgatttgcatttctctgatggccagtgatgatgagcattttttcatgtgtcttttggctgcataaatgtcttcttttgagaagtgtctgttcatatccttcgcccattttttgatggggttgtttgtttttttcttgtaaatttgtttgagttcattgtagattctggatattagccctttgtcagatgagtaggtcgcgaaaattttctcccattttgtaggttgcctgttcactctgatgatagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaatacaagggacgtgaaggacctcttcaaggagaactacaaaccactgctcaatgaaataaaagaggatacaaacaaatggaagaacattccatgcttatggataggaagaatcaatatcgtgaaaatggccatactgcccaaggtaatttatagattcaatgtcatccccatcaagctgccaatgactttcttcacagaattggaaaaaactactttaaagttcatatggaaccaaaaaggagcccgcattgccaagtcaatcctaagccaaaagaacaaagctggaggcatcatgcaacctgacttcaaactatactacaaggctacagtaaccaaaacagcatggtactggtaccaaaacagagatatagatcaatggaacagaacagagccctcagaaataacaccgcatatctacaactatctgatctttgacaaacctgagaaaaacaagcaatggggaaaggattccctattgaataaatggtgctgggaaaactggctagccatatgtagaaagctgaaactggatcccttccttacaccttatacaaaaattaattcaagatggattaaagagtcgtagcatctttcaaaggtgactaatgattttaacattattactataaacctatagatttaaacataattgctatgttttaacccattatagttattattcctgttgatgatcaagctctatctttggccagtgggagcctctgcaaattgattagtgaatctttttgacatggaactattagtctttgacaaaatctttgatttctggtatgacaatatattccagttttatcttatatacttccagtcctatacataatattaactttttttcaaagaattactggttttatttttagtgggaaatggcatttaaaataaggaagttggcgaggcgcagtggctcacgcctgtaatcccagcactttgggaggccgaggcgcgcagatcacaaggtcaggagttcgagaccagcctggccaatatggtgaaaccccatctctactaaaaacaaacaaaattagccagacgtggtggcacacacctgtagtcccagctactcaggaggctgaagcagaaaaaaataaataaaataaggaagtctgcctatatgggttatctacctcttttttagggctcaacctacccgtttcacacaaacccaactgaattcggactctatatgtgctaggcaagtttgagctttttcaggtgtacacacagggtttactgaactctggcatataattatttatttattcattttatcaagttttgtcctatcattgaaactcattcttgaataaagttattatatttagttcagttacagcagacaccccattttgaaaacattatgtcaacattggcttgtgtaccttgtcacatcagtaatgtacagttctcatttaccagaaatttttatatgaacaacatattgaagttattaagttaatgaattctgccaaggtattggtatatatttgttcattataagcatttaaaaacaaaggaaccttttaaagttgaagataatttaatgggccattgcatgcaaagaggtgttgcattagtaaccaaccttaaactactgctgaaacaactttatgcttgagttagatatgttgatgggagccaataattgtgaaatttgtgtatccagactctcttctgctctgttcttaatggatctagtgttaatgttagaatctagtgcatttcacaactgttgctattatagatggaatatcaggaggggtagtgaggtattgagatagatgaaaacattttctaaaagtggctcacgcctgtaatcccagcactttgggaggctgaggtgggtggatcacctgaggtcaggagttcaagaccagcctgaccaacatggtgaaaccatgtctctactaaaaatacaaaaattagctgggggtggtgtcaggcacctgtaatcccagctaccagggaggctgaggcaggagaattgcttgaacccaggaggcagaggttgagttttctccacagctttggatcctgatgacttttttttttttaattgttactttcaacttccttgctttgactgaagccatacttacatattactgataacatatgccatgggccgcgcatggtggctcacgcctgtaatcccagcactttgggaggccgaggcgggtggatcacctgaggtcagcagttcagaccagcctggccaacatggcgaaaccccgtctctactaaaaatacaaaaattagctgggcttggtggtgggctcctgtaatcccagctactcgggaggctgagggaggagaatcgcttgaacctgggaggcagaggttgcctgtgcactcgggccactgccgtccagcctgggtgacagcgcaagacttcatctaaaaacaaacaaagaaaaacataatccatgtatgtgatgtaaagagcgccaacatgtttatatcctcctatttcaatctacttttacttcatctacatttttagcaataatgtgaacatgaaatcttgaataattagctatctgtaatatatttactcatccactcaaaatattgagcccccccaataaatatcatacactatattctaggtacaggtgataaacaattcagagagtattaatttcaaaacatggtaagtgcatagtgagagagctgatctggtctggtggttgagggaatcaagagatatttgagttgaggtctgcagtattatagaaaattaactaatcaaaagagaggcagtcattccaaggaaggggatgtgagtcagaagaaactgcatgtggcaagctctgaggtgggacaaagcaaggacatattgaaggaattgtgactggagcatagggatggaggaaaacattgtagctagctgagaaataagcatggaaaaatgttgtagagctgtataggccatgttaggacttttgtctttatcttaaggataagccattgatgtgtttataaagacacatgatgtgatcagattttcagttaaatttaaaaaatacttggaatgcattttggagaatggtttaggggagaggcaagagtggattctgtgggccagtagttcagaggataggttatggtagcttggactaaagtgcctgagccaagatggagagaagtagattgctttaagacatatttaaagaataacatcagcacttagcaatgaactggagatggaagatgagggaagggaaggtgttaggcaggtttttacaatgagagaggttggtgatcatggtcaccaaggtagggaatgctggatgaggatgcagtttaaggtgaagattatgagttcaggttcagcaaaactgaacttgagacatggtgaactatcaaggtggagatatccagtgaaagttagagagaggggtctagagctcagggaggagtgtgtatccctaatttagactaatttgcattaacagctgtagtaatgcaattttctctatactgaaatgcagacatttgagtatagaaaattagcagacatttgaatatagaagaaagatttactttccttcagaaaaagaatagtagagtataaagaataatatttaatcctaggaattaataccaaaccctttaaaaaaaacttttaagttcaggggtacatgtgcaggtttgttacataggttaaacttctgtcatgagggtttgttgtacagattgtttcatcacccaggtattaagtctagtacttgttagttagttatttttccttattttctccctccacccatcttccaccttctgataggccccggtgtgtgttgttcccctctgtgtgttcatgtgttctcatcatttatcttccacttataagtgagaacatgtggtatttggttttctgttcctgcattagtttgctaagcataatggcttccagctccatccatgtccctgcaaaaggacatgctattgttctttttttatggctgcatagtattccatggtgtatatgtaccacattttctttatccagtctatcactgatgggcatttatgttgattcaattttttttggctattgtgaatactattgcaataaacatacacatgcaagtgtcttcataatagaatgatttatattcctttgggtgtatacccagtaatgggattgctgggttgaatggtatttctgtctttaggtctttgaggaatcatcgcacagtcccccacaatggttgaaccaatttacactcccaccagcagagtctaagtgttcctttttctccactacctcaacagcatctgttattttttttgactttttaataatagccattctgacttgtgtgagatagtatctcattgtggttttgatttgcatttttctaatgatcagtgatgttgagcttttcttcatatgattgttagccacatgtatgtcttcttttgaacagtgtctgttcatgtcctttgcccattttttaataggggtgttttattcttgtaaatttgtttaaggtctttatagatgctggatattagacctttgtcagatgcatagtttaaagaaatgttctcccattctgtaggttgtctgtttactctgttgatagtttcttttaccgtgcagaagctttttagtttaattagattgcatttgtcaattttttcttttgatgcaattgctctgtgtcttcctcatgaaatctttgcctgtacctatgttctgaatggtactgcctagactgtcttccagggttttgatagttttgggttttacatttaagtctttactctatcttgagttaagttttgtatatggtgtaaggaaggggtccagatttaatcttctgcatatggctagccagttatcccagcaccatttattgaatagggaatctgttctccattgcttgtttttgtcaggtttgttgaagatcagatagttggaggtgtgtagtctcatttctgggttctctgttctgttccattagtctgtgtctgcttttttttatgttcttaacttttatttatttatttattcatgtattcatttatttttaccagtgccatgttgttttggttgctgtagccctgtagtatagtttgaagtcaggtaatgtgatgcctccagctttgttctttctgcttaggattggtttggaaaattagggcacttttttggttccatatgacttttaaaatagttttttctagttctatgaagagattcaatggtagtttcataggtatagcactgaatctataaattgctttggccagtatggccattttcacaatactgattcttcctatacatgagcatagaatgcttttccatttgtttatgttatctctgatttccttgagcagtagtttgtggttctccttgtagagatttttttttgtatcctgagactttgctgaagttgtttatcagcttaagaagcttttgggctgagacaatggggtcttctagatataagatcatgtcacctgcaaagaaagatagtttgacttcctctcttcttatttggatgcctttatttctttctcttccctgattgcccttgccagaatattcaatactatgttgaatagaagtgttgaatagaaactaatgctgcaagcattagtttcaaagaacttcttgatttctgccttaatttgattgtttacccaaaagtcattcaggagcaggcgtttcactttccgtgtaattgtatggttttgagtgaatttcttagtattcatctctaatttaattgtgctgtggtctgggagacagtttgttatgatttcagttcttttgcatttgctgaggagtgttttaattccaattatgtgatcaattttagagtatgtgccatgtggtaatgagaagaatgtagattctgttgtttttcactggagagttttgtatatatctatcaggttcatttgatccagtgttgagttcaggtcctgaatatcttggttaattttctgtctcggtgatctgtctaatattctcactggggtgttaaagtctcccactattattgtgtgggagtcagtctctttgaaggtctgtaagaacatgattatgaatctgggtgttcctgtgttgggtgtatatatatttaggatagttagattttctcgttgaattgaaccctttaccattatgtaatgcgtttctttgtcttttttgttcttgttggtttaaagtctgttttgtcagaaactaggattggaaccctgcttttttctgatttgcatttccttgatatatttttctccatccttttattttgagcctatctcattgcatgtaagatggatctcttgaagacagcataccgatgggtcttggctctttacttggcttgccgctctgtcttctaattggtgcatttagcctatttacatttaaggttatgatcctgtcatcataatgctagctggttgctttgcagacttgtttttgtggttgctttatagtgttactaatttgtgtacttcagtgtgtttttatagtgactggtaatggtctttcctttccacaattagtgcttccttcaggagctcttgtaaggcaggtctggtggtaactaattccttcagcatttgcttgtctgcaaaggatcttatttttccttctcttatgaaacttagtttgaccagatataaaattctgggttggagtttcttttctttaaaaacattgaatattggcctccaatcacttctggcttgtagggtttcagctgagaggtctgttgttagtctgatggggttccctttgtaacctgggctttctctctggctgcctttaacatttgttctttcattttgaccttagagaatatgatgattatgtgtcttggggatgaacttattatggggtatcttactggggttctctgcatttcctgaacttgaatgttggcctctctggctaggatggggaagttctcatggatgatattttaaaatatgctttccaagttggttccactatcttccatttttttcaggtaaaccaatgaattgtagatgtggtctctatataatcctatatttctaggaggttttgtttattcatttttattcttttttctctattcttgtctgcttgtctaattttggaaaggtagtcttcaagcttggaaattctctccttcacttagtctattctgttattaatacttgtgattgcattatgaaattttgggggttgggagtggtggctcacacctgtaattccagcactttgggaggctgaggtgggtggatcatttgaggtcaggagtttgagaccagcctggataatgtggtgaaaccccacctctactaaaaataccaaaaaaaaaaatcatagctgggcatgggggaacatgcttataatctcagctactggggagactgaggcaggagaattgcttgaacctgggagatgaaggttgcagtgagctgagatcgtgccactgcactccagcctgggtgagttgagagtccgtatcaaaagcaaacctacacatttttgtggcctgtttttagctctatcaagtcagttacattcttctgtattctagcttttttatctgtaagctcctgcaatgctttattagaatttttagttcctttgcattttgttacaacatactcctataactctgcgaacttcattcctatccatattctgaattctgcttctatcatttcagccatctcagcctcagcctggtactgaacgcttgccagagaggtgatgtggtcctttggaggaaagaaggtactcttgattattgagttttcagtgttcttgtgctgattatttcttatctttgtgggctcatctaccttcaatctttgaggttgctgacatttggattattttttcttttatcctatttgatgaccttgagggtttgattgtgttataaggtcaattcaaccaactagctttgtatctggaagactttagggggccatcgttcacctcccaactcctggactgcatgttctaactctggatgacttgtattgggccccaactttgttctctggttcctcgaggtttggagtctactttgttggaggaccaaggtgtggcagctccagctgggtgctagcggattcaggggtgcctgcctccctgcaggcattcaccatgctagtgaaggcaaggcatttttgtggggaacaggaggctcctgctatagactgtctgtgcttttgcactggtgatggtgttggtttggtgagaggcactgaccagtgcagatctgagtgccttcttggtcacctgcaagcaggagggattgctcagggtgtgggaggatcctctgttctccatgcagcattaccacaagagtgaggcactggcagctgcagggcttgctggctgtgtgctgctaaggttctgtctgcaatggtggttgacagaggtcaaggggcatacttccctcctgtatgctagtggggcaactaaagcaaattccacctgtgcagacatgtgcctgcaaagtgatgtggggagttgccatgggctcaggggaagttgcagtatgggtagcgaacacccggctggtgtgcgcagtaagggctgtcttgctggagttctccactggtcaggcatggcccactggtgcagaagctattctgtgggccaccacagcacccaagatggccctagaagaggccagcagaccaaggagtgctcaggttgcaccagccctgactgatgtacaagaccactctgcagatatcaagtctgaaaattcccctagggccaaagtctattatgggagcaagttgagcctagagggatcgccatccctgtccatgcactgctgtagacactcctgcactaaaccctctgggctccacatcagctggcttgctgctctaccactttgcttgtctcttgggggctccaccccagagagatgtgggtcagcaatcattcagttcaatcagcccaggatggagagtctgtgctatgggcccaagccaggggctctctgtctggtgacgagcagctggggggtggggtgggacctgtgggagatggactggcctcctctccttgagtcaactgctgcttattggaggtgtggatgagacacttagggtctttgctcctttattagtcagagggtagcaaggacagttccattgcagaggtagtggcagagaggctttcagttgtccgtggcggctctgtccagggagttgctgagttgctattggcttgatatctctggtggggtgtggctagaggtccaggcctggaggacctgctcgttgaagagatgtgggaatgggcacccacataacagtctgttcacttttccatagggctgctgtagtatgctgggggccagctccagtccctggtcactttagattttccagtacctggaggtgtcaccagtgaaagctgcgaaacagcaaagatggtggccttcctttctctctgggagctccatccctgggaaatacaggcctgttgctggcccgaacacactggtaggacatggctgaagacgctagttgggagacctcacccagccaggaggaataggatcagggacctgctttcaaaagtagtcttgccccattttcatagaggagttgtgccatactgggggtatgctttagcccctgattgcctcagacactctgaagcccaaaggctggaatggctaagttgttctaacagcaaatatggtgggctgctcctctccctgggacaaaggtcccatggaagtctgaaacctctctcagtcagagaacaccagttggggtagccggggaccccagatgggagactctacccagtgatgaggaacgggattggggacctgctaaaaaaaaaaaaaaagcagtgtggccacatttttgtcgggcagctgttctgtgctggggttccccttccacccctgcttaagctccccaaagcctgaaggctggaatgggtaagttgcccaaacagcaaagatggcagcctgcccctccctctgggagctctgtcccagggagttttcagatctctgtcagctggagaacactggcaggtgtggctggaggccccagttgggaggtcccgcctgtaaggatgaatgggatcggggaccaacttaaagcagcagtctggccacattttaatagagcaactgtgctgtgctgggggatctctttggcccctggttagtttggactctccaaagcccaaaggccataatggctaagttgcccaaacagcagagatgggggcctgcccctcctcctgggagctttgtaccagggaggcacaatgttgctactggtggctagctggaattccaagccagtgggtcttatcctgtgaggcgctgtggaagtggggcctgtagaccttctctgctgatctcgctggattcagcctcttttctggggtatgtatgggagtctaacctcctggggtatgtttgggggtctaacctccagctttgccaaagtcgcagctacttttgcccagacacccagaaagctggagtagctaaagctcttgggtctccatgcatgcctgagtggctgctctgctgagactccacgtggctgtgtgtgaagggcctaatggagtgagttcacaaggggatctcctgatctgaggtttgcaaagatctgtgagagcagtgtggattcccagagttgcgcattcacttaccacttccctgggaaggggagtttcccttgactccacgtctttcccaagtgggctgtcttcctgccttgatttgctctggtctccgtgggtcgagttgtttccttgattacttccaatgagagtaccttaatgtttcagttgaaggtgctatatttagtcacccctttctttccgccctgtgagagtcacacacattaactgcttctagttggccatcttggccactcctgccctaaacctttctagcaaaaaaaaaaaaaaaattaataacatgttgatctaccgcttctctctctttaaatttatttaatcattatgaatttttttacatttatttacattgttaagctgttttattttaaaaattctaggtccagctcttcctggattgcttttatataaggaacatatctcatgaaataaataaaattcacattcaaatgcagaagaatctattggaaaaaactcagaggacaggataaaagcactcagaaaaaatgccaggagaaggcgtttatcacataatatcgctgataagagtctctcgaaaatttttctctctattcattcttaccaaatatagaaagtgaacaaaacaatattagtattagaaaaaacatccaaaaataatgacctttctgaatgaagactgcttttttcatggttactctttttggggtacagttctatgttgatttatccaatttatcaaatagccattcagcaaatatttattgagtgtctgttatgtcacaggcactcttttcggtcctcaaaatacatccgtgacaaagagtaaaagattcctgttcatggctcttacattccaggagggatagcaatttcttttgtaaagttaatcacacaacagaaatgtgaaataatattgatgctgtaaggaaaggaaaaataaatgaaataaattgaaaaagaaatgtgaaggaataattaaaagaggctatattttattgaataaaaataaaagaggctatgttttattgaatatgctccatgttttatactatatcataaaacatacaagatctggcttttaagaaatcaatatcttcatcaatatcttcattcagactcatctagattagattactctgaatctaatcacatagagacttgtctgacaaatccagattttttggacgttctgcaggactatttgtcaggatatttcacaggattccaagaaataatattggtgtccatgctataatgattcctcagctcctcccatctgataaaatattgatttcttatacatataaaacatataaaaatatttaaaatattttttgttatatgagtgaatcaataataaaaccactatctcaataatcatcaactgattgcaaactgattgttcatctcagaaaaaccttggcagagttaaaataaaagtttcaaaatacagaacttagtaccaaaattaaggcagtgttaggtttctaattttgctattcacatgttaaatgaattttcaaaattcagtagctaatactagctagggttttaaacaagacatagttaaaatgaaactttaaaaaaagaatcataaacttcagtatcatcatgatggcagttttaggattttaatgttgacaccctagtctcaaatttgtacttaatgtggttatatagctaggcagtgctggagtgaaagtttcaaaacaaattaaaatcaaaagttaagaaaaaaatatgaaggcaattttaaggtgtttaatttggcactgtagtttcaaaatagtacctgaaacttaacagcaaagtatcagattcatttataaaacaatgtgactgatctttatgtatggtttgtgaaacatttatgcagtgtcacttcagaaaactctgccattatagatttgaattgattaaggatatccactcctttccttggcatgatacaaataaattactaaagtataattgtaacaatgataaatataagtgacaataccaccatattactatgaaacacagattgattatggtataatacaatttagcatctccatatttttgaaaatgaacttgtttctctaactggcttaatttgggacaatttggacatcaaaaagaatgatgatgcaatttaaaccatacaaaaattaaaaaaaaaaatccaagggacggtggtgaaagtcttctttctagaagaatagcagctaatatacacagaacgaatcttagaattagaaaatcactatattttgatccccttccccaaagggtgacaaaaccattggtagacagtggttgagaaacagaatagtctcaggatatcactccgtagatttattcattaattaaaaagagaaaatgtgctttgagagagagaaagctattaccgtctttatcaaataggagagcctgatcatgtgtggtctgaagtttatctaatgggattcctgatggaatgtttagtctgaatctaatcacatagagacttgtctgacaaatccagattttttggatgttttgcaggactatttgccacgacatttcaaaggattccaagagagaatattggtgtccatgctgtgatgattcctcagctcctctcatctgatctccgtcctggcccccatgactttctttgtggtagttagggtgtggtatgtgccactgaggcccacacctattgctgtaagtgctgtttgggaaaccatcatctttcaggtctgtgtgataaaagaagagccttggggaaatgttctcttccaaatttaatctttacattattagaaaatattttgatgacctgttttcaaatattttcttataactttccattttcatgtgtttattctgacagtttattttatcttgtatttataatcactaagatgttagtattgtaatattaatattacatgatttaaattaggaaaaatgtgttttctattacaaaatggatagtggataatttaagtatagaaagtaatattttctatatgggactatttcactctctgtaatatcctgaattctaattcccactgtagtgagctataactttactaatcagttttcttacaatcgattttaagtctattttgttagatctaaagacataaagccaaaagttcttcttgaagagaagcacatttcagttacgtttataacttgaaatatctggttttactcaaaactcacatgtcatactgaaaaacagaagggagatgttgtcttttcttgaggagagacttctctgcagttaaacagctcaccacatgtttagagtacatagacaatacacttcctcttttgtaatgtagatttcagctttttgcttgtagaattatcattggcgtggaggttatacaggggaagtagtgaaaaatgtagccaataccaggaaccttaggaagtgtctgaacttcatcttttctgtgttcctttgcccttagggggtcagtgtaagagtttgggctaggaagagattgcttcttttactctatttagtttgtacttcctatctgggtatttgacaataaatgactcattctctttgtttgccctggtgttgaaaaattttcccatatgccagagaaaaaatgttacagtgacacaatgtaaaattgtaagaggtggaaaaagatgaggtatggacatagtgaatggaagttcagccctttaaaactactggcagagtagattttactcaggcttcaattaagtagacctgaatgtaaattcaggtctagctctgcaacttactaggtaagtgactttagtcctctttaagatttagtttcctcattacaggatataataatactatttttcttatgaggtaagtattaattgaaatagtatatgtacattctagcatacagtgatcccctaataaatggaacttatcattaatacattgctaggaaaagaaaaacacatcagggaacaaaagatataactgtcttattgataacaggggatggattcttgtggacaaaaaaatttagaattgaattttcaaggggtcatttctttcaccaggtgtagttaggtttgctcttatggtaacaatgaatatgtttgtttagcttcttaaaccggcatcatggaacgttaattaataaacagaattcaatgtatttgtggggcattttattttttatgcaatcatttgtatatgtcaccttcacaatgcatgccacattctcagaccacctattatgttattttcttaacatttttcttcaaattcactcacccttttaaaaactttactgaagtctcacttaagcacataatttgtaaaatcatgggtttgttgtgcaagttttgtttttctaatacactctaaaacaaataccttaaaagagttacacctacagtccatataccacccataatcatctcaagtacctccagtgcttgttactgcactttggaaaacactaacatacattattctcattagtttttataatagttatatgaggtgaatagagaaggcataactatacccattttaaagatgagaaaagcaggttcatggataaaatctcatagtaaattgctagaattggtcctgatactcatgctttctttagatcaacccagtgctcttactgtaattgataccaaattctttaaggaaacttagagctaaaagtaaaattttttgtatttagacctgattattttgtggtaatttgaatataggtcaatatgaaaaaaaataaaagatgaaacaaagaaactgagagcagatcaccaagttgcggtaggttagcctaagatagcttttggttttctcagccttctactattcacagctttgtgtaatcccctccacttgagtatcttgctcataccaatagaatatggtagtagagtagaggtcacctctctgataagtttacagaagattgcgacctccgtcttgccagagtacttcctctcttgctggttttgatgaagcaggctgccacagaagagaggctcacatggcagggacctgagggcagcctctggccaacagcaagcagtaaacagatgccctcagttcaatatccctcaaagaaatgaatcttaccaacagccagttgtgttagctgggaagcaaatctttccctaagggagatttcagatgaggcccccagccttggtagacaccttgattgcagtcttgtgagagattgtgaagcagagctattctcagaattcatgggtgttttaagctatgaggttttttttggggggagaatggtcatttgtgattcagctatacataagtctacaaaagtcattccagaagtgattcagtggaggtagaatcatgtggttgtgagccccaggcacttggagttctgatagaattgtgacttctaacactggacaccttttctttttctcttattctcccatttttctcctttccccttttcctcccttccttcccttcattccttctactttttccgtactttaaattaatagagcagttggaaacacaaaagcaatgtctgtatctacaaaatgtcattatttatactttgtatccacagtgtgctgcctagggcttcatgcctgaggtgcatctgtagaaggtgctcaacaaaggcttggctgttggtattattgaatcactgtggagtttattcattgttgtccatgccattttgagttttcatttttttatttatgggagtgtctttattcttttaaagagctttgtttgtacactcattttctctctctctcttttcttccacaggcaatttatagcactgatctgtcatcaataccacttgctgtcttggatgtgaagatgatttttcctgcagggattccctctacaaaattaaaaacactgggcatgtggaaataatattcatgctttaaattgtcttttctcttcactacaccaggggtccccaacccctaggccacagactgtggccctagtgtagtgaatagaaaagacaatttaaagcgtgaatattatttcctcatgcccagtgtttttaattttgtactggtctgtggcttgttagaaaccaggctgcacagcagaaggtgggcagcaggtgagcaagcattactgcttgagttccgcctcctgtcagatcagcagtggcattagattctcataggagcacaaaccctattgtgaactgcacacgcaagggatctaggttgtgcgccctttatgagaatctaactaatggctgatgatctgacgtggaacagtttcaacccagagcaccccccacccacctgcagaagaattgacttttacgaaaccagtccctggtgccaaaaaggttggggaccaccgctgcactacactacctaaaagattttcactttcacagtgttgcttgcttctgttttacatgcacaagtagctaaagctagccttctggtaaatggaggggcagagcagatggtgggggaggagtacatacggacgaatttgaatcacaatttcctcactatatgccagcaaaatttaataatagcacctaaacatacacatgcatatgtaaatgagtcacactataaaaacttttaacaagtactggcaagtcagatggcagacttaccctgaaacctgccactccaataaaaacctcataattaaaaacaaggctgtctataaagcataacatataataacaattatttgcaactggtacaaggctagattagaaagttgaaagttatctttctcaggtaaaaatgcttttcctatacagtatgcagccagcagattatcatccatagtttgagtagtgagatgccacttgctccaacaattaacacctgctgatgttggtccaagaagagactgaggtgatgcagtttcacctgttttgtaagaataacgctggtgtttgccatctattgacagagtgcctactacgtgccagatgctttgttggcactgaatgtgctatctcattccagtttctttatactcaatgaaaaaccaactacatttatattgcattgaggcttaaagtggtttactgacttgcttaagattatacaagtagtaggtggctacagcagggtttgaacccaagtatgcttgattccccaaaccatgctttttaaaaaatcaaaggtgtaacttcgataaaagacatgaagttaatgaatatatgaaagatggtgaatagatacagatacaatgtggccttaggccagatcatgttgaacatgtggtgggatagataagagaaggttcttctttgttgttacctggttctcaattggttattactttatgtgctttccatattaaaattctattattctggtctataaattcacccacccagacttgcctaaactaattaaaccctgaagtttggcatgtctcttttttggggtgcctctatgataggtggtagaaatgaaaatggaattaaaagttttgtgaagctatagcactactttttcattgtgttcccccctgactttctgccttaggtgtttactttggtgagatatcctgggagaaattgaggtgaaaagaagcccgagttaggattagggaagagatgaagtagtcaataaaattcaaattcttgtattctgaaacgcaactattctttctccaacttggttttggacagaatgtcttagtgtagctgttaacaaagaaattgatgacaattaactcccatttctcagaatttcatcattctttgaaagtgtttatcatactcaatcttctaaaaatccttaaggcatactacagtgtagaggttggcaaactttttctatagaggtcctgatagtagcttgtttcgcttttgagggccatcgagtttctgtcacaactactcatctctgctgttgtaataaagactcacccatagacaatacatgaatgaaggagtatctatgttccaataagacttttaaaaataaaattaggcagcaagactgatttgacataagggtcataatttgctaacctgtggtatagtgaaaggagttcaactagagtttgattatggctgtgccattctagttgggtagttttaggaaagttatttaatttagatttgatgtagttttctcatatgtaaaatggggataataaaacctgcttcacaagactactatgaggagtaagctatgtagctaaatatagcaaaatatctggcatctaatagatgcctaataaatggtgactataatgattcttatcattactgtattattttaaacatttatcttttttttttaggttgttgtctaactaaggtatttagagaaaataagtgctgctgagggcagctggaactgttttgctggttcatcactgaaattctagttcttgttggtgcttatttcataattatgaaactaattcttttgaaaagaacttgaagtagagcaacaagaactaagatagaactaataccattctctctcagttcttattgctttacttcaagttcttttgaaaagaattacatagatatgggtgcatgtgtttgtttattttccttgttgggtaatcgtgaatatgttgattggcgtcaaacatgggtctcacctatacccatggcagtaagcttctattgatttgaattcagactagccctggtggccctgtgagtgggaaagtctaggtgtgcctagcttggtctgtggttccacgaggggttggatgcatctgttctacttgtggaatgttggcaccaatatattggctgcttctccgagtatttgcctttgtcttctttgtgaaaggtcactggctggtttgagctattgggctgtttatgccacatcctgtgcatgccacactggctttctttctgtggtgtttccagagataagtttgcctgatagaagtcagactctgtggctttttatcattatagatttttctagaaggagaagaggccatgatcacatctgaggatcctgagtcattgtagacatgtactgaattaaagagaattttttgactaaaggagaattgcatcaatcacggtgaaggagatgccacaggacagggcctgaggtgttggcttagccacagatgtaagggctacagttaacagacaactttcagtttccactattggaagggatgatcagtccttccctcctctattttcttgagccccgtttttcacctttctttttctctctcctttcttatcatgaagaataaagacaaatgagaacagatctaccttaggctgatacagggcagggaatccatttaataataaaacgtgggtcaaaattcacttttctccttttgaattgaaattatattgtgcatgggctaattagattgaatgctgtaaacatgaagataatgcttgcaaagtagctacagagaaagagaaaaagcctaaaacaaccagtagtgcttaggaccaatagtataagtctttacacactacatttgaataatactgtaagacacaattctttgataggttaaatagcaaatctaggccccccaaaattatttaaaaaattgtcattttaattctagaggtataacaacagtgtgtaagttgcatcaaataacaaagttagtctacagcctaaattgtttcgtcctgcttttttcacttctatgcatatttttatacttccatgctagagctacctcattcttttaaaattgtgagatattctataatttatttgtattcccctattaatatatttttagcttattagtttacttaaaaagatttatgtttgccttctaatgtcaaagttaggagtcatctgtccatttaacaggtggtgttttcttgtgtaactcctctgccttcatgcaaacctttgagaacaatctcttgaaacaaggctaaaatgcctttggagaggtattatagatgatcatatctactttgtgcctctttccattacttagctgcattagaggcccagctgtgtaggtgtaactcaaaatccaccaaaactaatactgtggttagattctggtcaaacaagttgccattaatccagatgtagaatgggattgaaaggtggctcttccacaccctgacatcaatgtaccagtttggctctgtgcattctttctccccttctccctttaccaccctcatataattgtttgtgtacatgtctggtttcgtcactacgctgatggcaaggatcatgcatgccttattcatatttgtgttattcaaggattctactctgggttctattatggggcctggcctaaagtggttgttcaagaaatgtgtgttagagaaatcatacataaactagcaattctcatttggattcctgtatctgaacaactaactttcagcttcttcagtgggataaagaagaaaaatggggtttaaagtacatactattcagtattaatgtagaatttaacagctgccatccaagtgcagaatcctctgtagtttcccagtgttaacctcacttctatctctagccatgtctcagtgctgggtgactctctcctggcatgttctggcaagactctacctggtttgcgtaatctacatcggcttctagtttccacaagaattgtttatatgcatttaattttagctcttgggctataacatgtcattgttctttttacttatctcctcttacttctggaaacagggcaggcatcttcaatacttgctgttcctgtttggtgtgctcttagattaattttaactttcctcttcagctttcatgacacttcaagacattttccagtcatatttcctgtataagaaaatacagactatgtcaccacaaagggtagtggagattggggggcataatttaattcattcagggaactcatattttggtgtgaatggaaattaaagcaaggtatttggattaatttacctcatttggttctatattccatttagaggataacacattaagcttttattcaattttatctgttatggtcacagtgaatctggaaaaaaatatatatggggcttagttttcatatttaggggaaaatgaatatcctagagaataataataaaagttagggaaaataatgttttcctaagagtaggcaatgaaaatctgaaggtactcaaagcagtcttgcacaagtgctttgaaaagcctcttgcacaattttatttctttatagtacttacacaatcatatttcataatgacttgctataaacaatgttcttgacaagaagcttaaagatacaaaactgaaggaagcacttttgggagaaaatacttttatatttgcttacttctacactacaacagacataaaattatggatttttttttcagtgcaattttcatatgtcagttctaggagacaggaaatgtgaaacactgtaggaggtatgagtttgccacctagaggagagaggtgaaattcaacttttctccaatttctttagtataattcattaatttatttaattatttactcgtttaattattcaaaaataattatctaccaagcttaactattttgccagcgcagatttgataaatctgttcaagatttatgagctcaaagaaaccacaaagtgcatcttactttaattgctcagctgcctcttttaaaaatcttttacttttaagagagtatagcacaaatatctgaacaactctaaatatccatacttgggatggatattactttgagctcttgcactataataaaactttattcttttgtactaattcagtccttttactttttcttttttaatgtttaagaaacaagttggatatggacaagatgtaatttcttctgtcaaggaacccacaggataataggttaatgatagagaccaacaatgctgatgcatttttaatgacggagataatgtctagaaaaaaatccattatttggtaaagacaaagtatgcatatgtattcctttgtttcaattatttttaaagttaaaaaacaactgcttatctccttttgtactacaagcaatatctggtatagtgtatgcatagtaagtattctagaaatagtaatttcattgttgacttgattatattggagtggaacttactctggaagagatcctaactttcatttatctgagaaaatttccagttaggacatggaaattttttccttgtcaatatttattcttaatgtgtttagaattttagaaaatgggtttagggatttagaaatttctttactaaataactctagggaacagtaccttaaaaatattcaaaatgacaaaaacttaaaatgacatctaattttttaaggccaagaatcattaaaaagggatccaaatctttagactttgttgctcggtggaactagaatcattaatatctcagtcaggggaagccatgtcaacttactggtttaatttcctgtgagcttcccatgttctctccctgcaaggaccacctcaaatccctcagtagtcctgtctttatgaaaccagtataatttttcttttcgctcttgtccttcaccttcctgtggcaacaagagtcaattctccatatataaatactcggcccctgttttagctgtgtcttaattgcgcaacatctgtttactctgtgttttaacatctgtgtggatagcattgttgttgtaatattttgactgtaagcttctaggaggtagaggccagcattattttctccatttttggaatgagaaaatacagattaccacaatcaaagtagaatggcagcttatagtagttatttggataatttatatagtctcttaaaaaaacagattatagtaagaagtggctgagcaattagctatggcacactgcacggtttttctgacctctcagctcctaaataaactttgccaaatcttcaggccctcaaaattttttcattccatttgttatgggctgaattgtgttcccccgaaatgactatgctgaagtcctaactcctagtgcttcagaatgtgaccttatttggaaacagggtcattgcaaatataattagttaagatgcgatcttactgacataggagaagctcctaatcatggtgtccttataaaaaggagaattttggccatagagacatgcactgggagaatgctctctgaagactggagttatgctgctaaaagtcacaaaattaacagaagctacggaagagaccttgaataaattcttccctgtagccttgagggagaggatggcccagccaactgctaatctcagacgtctagcttccagagctgtgagacaatttctctttttaggccactcagtttgtggcactttgtacagcagtcctagccgactaacacaccactctaactgttgatcaaggcaagagcctgtgatcatgtattatcttgcttattccttatcagcattctatggtgtagatattagtgccatctatatacaaattaggaaatggagcctcatagaaattaaatgacaagttcaaggtgtcatggctatttcattatagtgccagtgtttgaacacaaatcaatttgactccaaaacatcattactctactcaattctagttcaatccagatgttcacaaacaaccagactatagtggagatgtgggtggtgggttgagaaggagatcataaccaacatcagactgtcagtgaagcagactgggagaagttttatgaagccaagcagctgtgcaaggtacagtagagatggtcagattgttcatgtgtatggattccatcttctgaggaatgaactccttgatattcctgagttagtccagtttaggcaggagtaaacagaaggtaaacagaagattggagactgtgtgtgtgcacgaatgcctcctttgtagctggatgtctaacatcatgatagccacactcacatgaatacagagatacacaatttacaaattaatgtaacataaaactcccatgcagtctgatttcatcttactgacatttctgtcagtcagtgttagcatcttaattatataaatgtggaaactgaaatactcaagaggttccctgacttcccaggccacacagtaagctttggtgccagaatgtatctctaggctttctcatctcaacccagcattcattatactattgctcactgcgtgtagaatcagatttgatttctctgacttttcttagtcacttctgtggttttgtaccactccctctctcactaaataactgcctgcaaaagtaaaaatttccatgaaaacagaaaacaaatgtaccagaaatgttgatggtgtaagagataaaactgggataaagagaaaatgtgttggaaagtggtgtcctttaatgcaacagaaaagtatattgggagaaaaagaaaagagagaaaaatagacaatctgaagtgatgagaagagcaaatgctacagatgtacctgaacctcttcagtaggtgtgatcctgaagagttgtgtataacaacaatgaacaaaaataaaatgtactgtggaaattgtctagctgttgagatcctcctgtgcgatatttttcaaagtgaaaactccaatcaaccctagcttatttatggagaagactttgccccacagtacccagaaagtttcttgacaatatcatatatgcataataaccctgagacaatttttgtttaccaggaaaacatataaaagggaacattaaactttgtctagttctactgcataaacatgtgataatgtgcatggtgaccttctgttgtaaatggaaagagttaagctctctgaatctactgctgaaaggtgaaaacactttcttagggctttgaacttcatttgaaatcttactgaaaaaacactacagactctattttctttatatttgaagatactttacataaaaatctaaagcattttgacttatgttttcatctacttgagaaggaaactcacagactccaaagcaactgttgtctgttttgaaaaaaatttcagaaatcaccagaagcaatagggagtggccttgattcctgttcttgtatttatgggtagctaaagttcatatttctcaacataccataatctctgtgtaattggccaaattccatggtggataattagatctagcttaccagggcagatttggatggtgagagcagtcacactgttctgggaatatgttagccaagtttactatgttttacatgagttgacagactcacctcacttgctgaaggactagcccagcaggttctacgggtgagatcactgctagctcattcactgctgggcctggtaggcacaagaggccaagaaataaataatgtgaatttgggcttcagaagttctctttcctattttctttcctaaaccctttcttctaccagctgtctaggggctaaaacatttgttcatacgtttattaactaattcaacaaatatttaccaaccatgtttcaggcactggacactagaaatataatagtgaactagacattttctgccttcaagggtctatgaacaattataatattctgaaaaatattacaattcacagagctcagtaatccaaatccttattatttctgtctttaaaaagcagaaagtgaaaaatgctcttaaaagaggatggcatagaaatgtatttatgcattgcaacagataaaattaaggaatgcatgaagactggttcatctgtgtggttgtgagtcaagaataaatcccaccctccctgaagtactcagactctaccttgccccatggccaccactgtggcccaatggaagcaccagtccagggggtctccattcatgctgtctttggatgtcttcagaatgttgtttcacaagtactcagacccaacagtaagattttaaaaattgtccataatattaaccttggcattattatgttaaagaaagcaaaacagatatcactgagtttacttctcaaaaaaaccttgcgttcctgcaaaagtttcttgaattctgactcttgtcacacaatcacacaagaatggctatacttaaacccttctaatcaattatatccttaatatgtatgactgagtgatgtgttttcatgactatgaaatgtatacatgtttggaaaatctattcacaatagagttttatgatattcctgttaacaggctgtcattgtaacactgtttatgcaggaattgtaattctatctgtttttatttttagcgtcttttctctccatcccccaaattttaaggagctatcaggtctgtattttatttggttttgaagttttaggttatttgtagttataatagccatatcaattattcatttagcaaacatgtattgagtgctactatgtgcttagatttttccaatgttgtgaaggataattggctaaaacttttccacttttattagtaatttgagagtttttttctccatggattttagtcactggtaaaggctgtttcatattcatagatttttttctacggtaagaaacatatgatgttgaataaggtatgaattacaaattaaggcttttccacattcgctgcctttataagatttttttttcttcatcaaaatctattcacacacacacagacacacatgcgctgttttgattttcttcaaatatatccagtgttcagttcttgggcacatattaatatacttgcctagatgaagactatgtgtcctcaggaatttataatctagcaggtgaaagatttgcttctttcaaaatgtgactctacttccccactccttaggttgtgaaagcagttgtttacgctttatttcattgttttccaaactttagttatttatgtgccatcttcatgattatgctattcacataccacctatactattatgcttctgaaaatatactatgattttcaacttaattaaatttgtttagtaataacagtagctgttacatcactaggttgatgtgctagttaaaaatttttaaatatactttaatataaatatgttactactaaattatttttttgtctgtatgcacccaaaatcttgcctttagtagtactacacatatcatgctttgggaaactctacccatgagattcatattcaagcatgaggaatggcaaaagaaaatacagaaatagtgatagtaaccatagcaatggtaataagagctattatttattgaggactttacgtatgtcatttaattttattttatcctcacaacaaattttagccatgagtatcagataaatatgaggcaaaagggcaggaaagaaggaacagtggaagtcaagctttttttcgcctaggtcagctataactaacacgacaagatgttttagtatttgtactttatttttagtcagctcagatttcacacctgactattttacaaaaatttggatgtgatggtggcagattaacataattacttttagcaattattatgggacaaattagttaaaggttgtaaaatgcctagaaacagagtagaatatcctagtaggatatcctagaatatcctataattaagttatcaaacaattactctgattatttttcacagtagttcaatcaaagtgtaactttgggtctgttagtatacatgagtgtgaatactctggagatttgatctttggctttcctgtgtaagttcatatatatttttgttattatcctgtaaataactgaattatagtacagtgattctgtaaaaaacactttagttattaatattctttggtgtgaagttcacattaaaaattgttatatttccagaacctggtttttacctgtgaaagtcaatgcatccttcttttaatcctctgcattggttttgcatagcttgatgaaatatgacttgcttctcctccctccccctccttcctgtgcctgtatccccatcatttttttttctattcctcttggtatctggacttctttttctgccaaatgagtcagtaagagaggaaatgtttaacccacatttgtcatcttggctgggaaagaagtttgaaggcaaaaggtgcctgaatatgtttcactaggatgctgacacaacctttttgactctctcctaagaatactactctatattcaagttataaagtgctaaatgatctatttccaccatgtatacatttcatatgatcaatacttattttgtaacttttttctttgaggagaagtatttttcttttggaaaaatattatttatttgtgtgtgtgtgtgtgtgtgtgtgtgtgtgtgtatttattttcttttaatatgtggtctccctatgcaaaggatttgattttataaacagaagcaataggattaagaggataaaggaaaaataggagaaggggaaatatgagtatcatgataaggtaaaaatgaattgcttgtattctaacatagaatagctactacctgttgagtgtttattatatattagacatttaagactaatcaaaatatctaatctaatgaaataatcactgttttgaatttgcttagatttagtagatgtagaaactgagacttagagaggtttatttactcaactccacactgctaattactggtgaaagtagaattttactcctctggttttctcatccagcacatcatcactataacccttatagtttgcttttggcacaagtattcattattaatggaaatgcatagtattatctcagcaaatgtacaaatagtttagcttcactaaactagtcaattttttttttctaaacatcaatgcttaggaagcaaaacaggctgggggaacagtagttgtactggtggcagctgtggtgctgatggaggaagtggtggaatgcataggctgctcatgctttttgccacaatgaaggtcaaaaagtagatcacttaaagtctaaagttaaccttgggggtcatattcttcaccaaaaactatgtttatacatatagacttagcagtatgctataaaagtgaagatatagcactataaaattccaccataaagtaaattgttcaagattgtggtccaagctcttcaaaatgctcataaatcagaaggtgtatttattaaacaatattttatatgtacctataataatacaatactatactacacaaattggacctaaaatgaattctcttgctatattaaatattaaacattaaataggcagaaattttgtttgcactggacttagaatataagaagaaaatttgggacaacctgaatagttgaggtctcttgagaaacccttcagcttcttttcctccaaataaatttctctgtagcaaatggaagccatccaaatgattccctagctacctcaaagtactgtaatttgtctacttcacaaagtggaggactatatctagcaataattcaagaaaaatgcagtgactcccattatatcttaggcactatgctaggaagtttatgcatatcattttgtttgattttaatagcaacttcatgaaataaatcatcataataaatcactatttcagatattgagaaaccacagaaagagagaagttaaataattttcctgtcaaagaccacatcaatgatgaagccagaatttgagctcatgtacttaaccactggactacctgcctgccctgtcgaggaacagctaaggttgtcatagagtcttgactgtgtatagatagttgtttgaagagagaaaaaaggcaggaggatctggggcatatgtttaaatcaggcattggcatctgtactagaattgaaaggtggaactattattgtgttctatttattgagtataggtataccatattcaatgtatttctctgcttcatacactatccaaggtgataaaagtgtttatgaagagggattaggaaatatctgctgtgtttaggtcatagtccaaccaaaggattaattaacatttgcctcttttttctcctacatccagtgtcccttttgatgagaagaataagcctcattctgattcaacagcagagatcaaagaaaagacttctgttttctggccaccagatatatgttatctgtgcttaaagaattgaaaaacacacatcaaaggagaattttcttggaaagagaggtaatgagatacagtgaaagagaatggagattctttaaatcacagagacctaggatcaaatcctgtgattagcactttttagtaatgtagcctacttcatttctttgagccctcgtttatttttctgaaaatgagggtgatctaaattacgtctggagtagtaataaagattaaatccatgtgatacaggtaaactcatgacaataatagacatgaaacaaatagtctttcatctccctcctttgctcaagcattgctctgctcttctcacctcctttcccttcctttttcttttctcctctttattttgtctgtacccaatagcttttcccaagccttaaaactatgtataggtatattgttgcagcaaaatgcataaaggagacactcattatttgcatccatttatatgctgatataaatatttcatcctcacaagtttcagagggaaagaccacatgctggtgatttggtgagaaagaagcaactatttctgtgatttaatttcaacctgagcattaaagaggcaccctttcactactagtggtaactccatgcttccaagaactaatgagctgaagaacttagcacttgtgatgaattagtcaagcaaaaattatgaagcgagtaatctataacattatagtacattacaaatgctgaaatatattagttattatttattatgattcttatagctcatttatactgtacaaaattcttctgtcattttatgaagatgttacacatatacataacaaaacttagctaattagatacaaagactatagaaccaaataactcttttctaaatattttccctttaaggaggttttgcaatccagctttgctgtggttagacactgttgatgagaaaactttttttttctttcttttttttttttagacagggaatcattctgttgcccaggctgtaatgcagtggcacaatcatggttcattgcagcctcaacctcttgggctatagtcgtcctcctgcctcagtcttctgagtagctgggactatttgatgtgcactcccatgtgcggctaatttttgtatttttttttttttgtagagatgggttttcaacatgttgcctaggctggtctcgagctcctaggctcaaggtatccacctgcctcagcctctcaaagtgctgggattacaggcgtgagtcagtgcgcctgacctggatgagaaaatattgagttggaaacccaaaatatgacataaataattggtatattttagagctggatttcaacaacttttcaacactgtcatcctgtaaatgtctttccgtcctaatcccattgcccatgcactcagcagaagtgtgtgcctctaaggtggatgctggtatgaaatatctcagctggggcaggctctgaaagggagagatctggttaaagtgctcataccaaacaaagctcctcatgatgctggcctaactctcccaatcctgcatttctcaacaaaactttttgctcttctctttcacataactcccgtggaataatttccattgaattgcatggaagaggctgttcatggggttagtctggcagataagaggtctccactggattttttcattttgcaatcagtttcatacatatacgtacatacttttcttggagtcatagttcattctcaggtcttttagagttaaatatctttcatttcttcttttaaggtcttaatttcttgtttttcgagtttcatgggagatatccagtcaccaatccaatccatatcggggaaaagtacaacaaatgagtgaaatttgtaaccaaccttggatgatggaataagacatttgggagaacacaggagaagtggggaggttaaggagggatagctctgtgaaaattttgcattactcttgcctgaggtctactcttccttgtcatgttggtggctgttttgacaatgagaaatatttaatggcaaacttagtcttctaatttgaaaatggaaatcataacagttcttgcctcttagggatagtgtgagacaagtgaaataatccatgtaagaggtatagtactatgcttgccattctttaagagctcaacaaatattcactttttacctattagtatcaatcttaattctaaaattctattatttaatattttccagtggtgtttctaaataatatctaatgactaggctaatacactatgtggttcttctagggttcaagcatcactgttaggtgtgctggaatcctttcccgagtcagtactgctttctagaagaaaaccggggagatctatttggaatgtatctaactccaaagaaaccatcagaggtaacaggtaggagatatgaaacgaccttttagatatgaaccctaattgaataaaagttgccaaacaactgttcccaaacatctaaagaagagttttagtctaagtggaatggctggagagtatgggaagagttctttcctactctgtccaaacacaagcctctgtgacatttatcaaagaaatgcagccctttaaatctgggtataagtccgaaaggtgctttccttgtgaagcttcttttgtcctctgcttttaggactctctgcacactgcatcctctatgtcaccctccagtacatctgctcttacacaaggggccccacagggactggcccacacaccagccagggcacatgggccaacttttaacagcaaaaggaaatgctaaatcctagagtagggcagatgagaaaaatggcattcttcagagagctgggatgactcacattaagatcaagggccctgaagtaagacagacctgagtctgaatctcaattccaacaataaatttgtttatacacttaaggcatcatgtatagtattgttaaatagatactttacaagattgtaactaagaggaagcaaaataatatctgtaaagcgtttcatagattggccagcatatagtaaacatttaataattagtagctattattatttttccttaaatattttttttctggcttcctagcaatcataaaatttagtcttgtatagactccatggctaggacttgcagaattaaaaatggtctgaacaatttagacattgcctttttgtcctcaaaccaaggggtgaatttttattctaaaatatccagattgtccatatcacttaaccagttgattgctaagtctgtatttctcttttatgcaattgggaaacattaaaaagttgaatgtatatactgtacacatacatgcacacacatagacttaagtacataaatgtgtatgtaccttccatagcacttagctcatctgttctttcctatgaccttttctataatcctgtgaagtaggttttatattatcctattttatgattaaaggagaagggaagacagaaaagcagcctggcttggccagaggccttgcaattgattacgtatagagccagggagtcctgaccccttttcagtttttcttcctctgtactgctgtgatgactgtggaagtgaagtacttctttggctgccaaggaagtcccagctgaaaggtaaccaaaggaaaggagtatttgggagcagcatggctgaaatccagttaacagttaaaatcccgttgggcaatttctcgttaattgacaacaggaattgctgtcactgtcctgtctagccactttcaaacggtggggatgttagcaagagctcccagtgaatgcttcctaggagagcagtgattgctttggctagcttcttctgtagcagttttctggcggtgaaaagtctgtactaagacaattggaggtggtaatcattttctaataaccacctcaggcttttggcacctaattcgctggcactgtctagggaagctccttatgctaactcatgcttcttgccatgtcaatctgcttatctaattttgctgggaaatctgatatcacccttcaaatagttcacctcagtgggatccagtgtgtgacctgcaaagtgctcaaggaagagtctgatcagctctgacaagcaaacagcagaaagaagttttgaaaaaacggctaccgtttttgcagctttttcactgtggttccatggtgtttgaaatcagaatgtaatattgagttaatgacacaaggaaacacttggatgttcatattgtctacttggttttcatgaacctcacatggactggcttcatcctgtttcagagtccattcaactgtaatttccactctacttcctgtgcaggccttcctctggtttgtgggctgtacatttcagcctgctcctttaaggggccccctgagctgaaaatgaaagagacattttgttgcttctgctacctgcttatcgtccaatcccaatctcagattttctttttctattttttaaacccgagtagcacttttccaactagtgtgtagtttttctttcaattctctgctcttcacagtaattaaacaagagctagcctccttttccaaatcttgtttttgtaatacctttattcccaaagagttatgcttataagagtaacataaatgtgttaaacttggtattgatttgatgatttcataaaccccagactccttgaaattctgcaggtttttgtgaaaggacttgcttaaaatctttgctaatctacctgaattttcttccaaaggcagttatatacaatgtttcttaaaactaattctccaaatttgcaatttggcagcatcctactgggactctagaaggctgataaatcatggagagtaggtattcatataggaactatgaaagctgtatgtagtaaacactacttaagaaggccttacatttcataaaaagttggagatttttgtggagactcataaaatgcatcctttatatcagtgaagtttttgcttctaggtatattatactcacatcgaaacactccagggattttgttttcagcctgcatataccacgtatatttattatctggatagataaattagacgtatacatttaaaggagtttgcatcagctgctgctaggaagtttttcttgtgttagttaagatcctgtgaaacaacccttgacatttcactagctgcacagtttgtaataaaatccattttagcctgaggttaaatcatgactgtggtcctcacatcatggtgggggatcctggtggccagattaaaggaaactccacattctcatttctgacttccctacaaccttgtattaagaccttaattgaaaaacttattgcctctctcaccaaaatatttcaaattttaatagtttcccccaatgaaattacaagtactattttacttttttcagtgcccttggaatttcgaggctggatggggggcttcaatgtctgactcattaagtgttctatatacaaagccctacatggtccctagagcatagcaggcattcagtgaatgaaatgaatgaatgaaaagctagagtcacattttagtgacctaactgtatattttcagagtaatgtagtgcttaaaaaaggacaatgataacacgtttctacaaagagatgcatgacagataacacttctcaagaagaaggaatttagcttctgtcatttgatctaggttttcaattacagaagcattgagaatttcctgtggctggataagggcgaatctttaaggcaagttgaagacccaggctgcccatgtggacatcaatactcccacagagcactcttcatgaagaaaagtgtgggcttgctgtcttttcatcaaaactcgtagaatttggctgactgcctggtttatcccaggacattagtcagcccacaaatcccgcatttgtttattcagtccagagcaagtgaatactgccattttctcatctcctttgttggcaacactttgttaacctgaattgggttctcaacataaaatgaagtgactaatcttttggggggttccccctcccaggttcttgtatgagcaactaaatctacacaccacaaagccccatgctgtcattttttctcatcctgcccctttattttgatgattccacattgtagttcatgaaaccaataccttctagagtgtggctgaactggcgccagcattaagaaaaggagtttccaaactttttagttttgtgagaaaatgttagaggaagagggaggttaggttgactatttatacttatgtaatcttctgtgaatttgcagtagttatcaccttgtactctcaaaagttttctagctctgagtatgtgaatctgaaagtgcaggaagtaggaatcttagcacaaaacaaccagtttggattatcacacaattaatatgggacggagctggaggatggacctgaacagaatgtatattctttatcactaggttatttatctatctacagatgtctagaaagacctgggcttttttagcaaacgtttgagaatctaggtttctaagtttccattgaccatgaaagagtgattagttttagaagacagttgggggcaacattgtgcaagtcagaagaggggatgaagaaaatcataaagctaaacatgtttgccataggcccaggctgtttttcagcatgtttcacctagcagcttggcagataattcccagtgatcattaggtctgtggaaattctgtttggtttataaagttttggccctgactatgtgtaccactgataacttgtttttctctctcttcccttttcctccaactcgtagccagagctaccttccagatgacttctttctaccactttctttcttcccagtgtaagagaatgcaagtatatgctgatgtttggagcaagaacattcaaaaattttcttattaacataacttctaatggaaatacagtatactactatggtgcatacaaagaagaaatagcaacatatatttgttttagacctgattgctgtattttattccttaggtcctccttgatgtcttgtagaccgtcactagctaattgttacagccatcgaaggaaaaaataaggatttttacttaggacatacgtaacagaaaaagagatggtttagcaaaaaagcacaggctttgcaataagcagccttaaattaaaaaaaaaaaagttaactcataactaactgtgtgacctgggataagttactgaccctctttagggcttagggtcctaatctgcaaaacggaaattataataataaccttagctagcatttcttgtgcacatactataagctggtgataaacaatttatacacactatctcatttaatcctcacaacaatcctgtgagataggtactattatcatttctattttacagatgaagaatccagacataagaagtgaagttaagtaactttctcaaggtcgcacagctaccatatgatggagctggaatgtgaatctctgcagtttgacgccagagtgcatgctcttagtcactacatttgtctacaaatctaaaacacgtaagacacataggaggtgctcagttagtggtatctattattaaatcagactataaataatcaccaggcaatacttgaaaggccacaaacaatttcttaggatttgtgacaatactaataattataactgattatgagcataccttgtgtcaggcacttcttttcatagtatttcagtcattatttaagagatttattcttatttttatttttctagtgagaaaactgaggctcaaaaaagccgacaaatttgtttaggattacaaaaatatcaaatgataggattgaaaatcaaatccatatcctttctatgtgaaaacctgtgttctttcagctttttttatttttatttttttattttttatttatttttttaaatttttatttattttatttttttattttataagcctttttatttttatttattttactttatttgttgttgctggtgtttttttcttgagacagagtctcactctgtctcagctcactgtaacttctgcctcccgggttcaagcaattctcctgcctctgcctcccaaggagctgggattacaggcacctgccaccatgcctggctcacttttgtatttttagtagagatggggtttcaccatgttggccaggctggtctcgaactcctgacctcaagtgatctgcctgccttggcctcccaaagtgctgggatttacaggcatgagccaccacgcccagcctgcctgatttttaaaattattaaattcatatttgttatttatcagatgcctctgccactttattttttaaaaatttatttttattaaggtatagttaacaaataaaaattctatatatttattgtgtacagtggaatgttttgatatatgtatacattgtgaaatggttaaatcaaactaagatatctgtcatctcatatgcatgccatatttttgtggtgagaacatttatgatctactctcttagcaatttttaatattctgctgtttgacttttaaaccaaggcttggattaggacagtctttgtagcttagttttaggttcagggataacaaaagttgttttatcctttgggcttttgcaacttgccattttcttaatgaagatctgggagaaaaattagtttaagtggtttttaaaatagccattagctcaggacatactcagccaaggcaggataagtagttttgccagcattcttctgtaggtaggttggttgttttttgtttttttgccacagtctttttaaaaaatataactttaaaaaaaccttggttttctgtgattgatctttttcactattttttatagagggccaggaatatgagtaaataattcttgggcttgggtgcagatgatccacgtgctggcagacagaaatctaaagggacaaaagaggctgtcctttgaagatacttttcctggcttgggttttatatttttggatttgatttagtgaaaatttttattgaggacctactgcataccagacactcggctacattatgagaggtttggggggcctatattggcatatagggaggatgaataaagaatacaaacaattatagtacaaatcagaataaaatttggcatgcaacgggctatcagatagtatggaggaagaaagcatattttattagtggagctaggaaatacgttacaaagttgatagcattcttgatgggtcttgaaggttacatagatttttttttctttttttttttttgagacggagtcttgcagtgtcgtctgggctggagtgcagtggtgcaatctcacctcccgggttcaagtgactctcctgcctcagcctcctgagtagctcggattagaggctcctgccaccacatccagctaatttatatatgtgtgtgtgtatatatatatatatatatatatttttttttttttccagtagagacggggtttcaccatgttggccagactggtcttgaactctcgacctcgtgattcgcccgcctcggcctcccaaagtgctgggattacaggtgtgagacaccacacccggcggatagagagaattttgacaggtgaggaggtattccaatgcaaaagaataataggagcaaaagcacagtggtgagaaattggaggggaactgtgaaaattgccacatagattagaggcaggaaaataaaggacggctaagtttatatagtgaacagtgagccgcatggacacaggtgactgttttctcctttttgaacccctgcttactccagagtcaccacctctcctggctttctgccaatcttcttggccacagtttctcggtcttcttttctggcttctcttccttggcctgaatgctacatgttaagtgatgtcagcttcagttttcttaacctctcttctcttaagttgctatcatttaaatatctttaaatatcatctacatccaagtgacctctaaaccagtaattttacccatgacccatctcctcaactccggattgtatataaaactgtctactcaacatcttcacttttgatgtctaaatctctatgtccaatttagaattcttgattctttgctttccctccctcctggaaatcctgctcttaccagtcttccccatcttaattaatgaacctgacattcacctagtagcttagtcctcaaaactagggattaatctagatttagtcatttttcttactcttgccatataataacatattattctgagtttacctttacccgaccccaaataggtaactgctgtttttgttataagatagtaatatttgcctctgagtgtatgtgaattattttgataaaaataaatattatttttaaaatattaattttacagggattgtctcttgatttctttccaaaagttaactcataagttgttcagcagagctatgtattcttcagtatgttataatttcgttccatcttccaaaaggccttcacattctcttggcttacagactcagatgctatggattagatacacaagtacatgttcctgtatatctattatatagtgaacataacaattatgattgtgatcttccaaagctcgtatttttaatcaaaattaattaaatattttaagccaaagaataaaggtagatgcagcatctagtcaaaaggatatttctgctggccacactcaggaagacataaagatatagttgtagaaagtgatatagtattggccaggtgtggtggctcacacctgtaatcccagcactttgggaggccaaggtgggctgattgcttgagctcaggagttcgaggccagcttgggcaacatggtgtaaaccccatctctacaaaatacaaaaattagccaggtgtggtggtgggcacctggagtctcagctactcaggaggcagaggtggaggattgcttgagcctgcgaggtggaggttgcagtgagctgaggtagtgccactgcactccagcctgggcgatagagtgagaccctgtcttgagaaaaaaaaaagcaacccagtgataggctgggcaaggtggctcatgcctatatttctagcagtttgagaggccaaggcgggtggatcacctgaggtcaggagtttgcaaccagccttgccaacatggtgaaaccctgtctctactaaaaatataaaaaattagccaggtgtggtggtgggcacctgtaatcccagctactggggaggctgaggcaggagatttgcttgaaaaaaaattagccaggtgtggtggtgggcacctgtaatcccagctactggggaggctgaggcaggagatttgcttgaatccgagaggcagaggctacagtgagccgagattgcgccattgcacttcagcctgggcagcaagagcgaaactccatctcaaaaatgaaacaaacaaacccagtgaaaaccagtattgaaaatagattgcctctcccttgcttcatggtctgttcttacgtaattttcaagataagttcattttggcgggtactgacaaatttccatttatttacttttttcccttacattcatttcttctcagtctctccaatgaacgccttcactgatatccaaagcatgaaggacacaccagggaaaaacatagacctaacacaggacaaatggaattattagaaacattttctagcagaagaacactattctgttgccatttgaatctttgcttctttctaggtttgacaatgagcctatcatataagcccaaatgtaaacagaaagaggttgaatcagtcacgataagcccaattatgctgtggtaacaaacaacctcaaaatctcattggcttaaaatatacagaattattcttactcatggcacatatccatctatcatctgcaggggatctgctcactgaagtcacttaggaacttggactgatggaacggccactttttggtcactatatgtattaatctgttttaatcctgctgataaagacccaaaattgggaacaaaaagaagtttaactagacttacagttccgcatggctgaggaggcctcagaatcatggtgggaggcgaaaggcacttcttacatggtggcagcaagagaaaaatgaggaagaagcaaaagcggaaacctctgataaacccatcagatcttatgagacttattccactatcaagagaatagcatgggaaagactggctcccataatttacctccctctgggtccctccctcaacatgtgggaattctgggagaaacaattcaaggtgagatttggtggggatgcagccaaaccacgtaatttcacccctggcccctccaaatctcatgtcctcacatttccaaaccaaccatgccttcccaatagtcacccaaagtcttaactcatttcagcattaatccaaaagtccacagtccaaattctcatctgagacaagggtagtcccttctgcctatgagcctgtaaaatcaaagcaagctagttacttcctagatacaatggtggtaccagtattgagtaaatacagctgttccaaatgggagaaattggccgaagcaaaagggttacagggcccatgcaagtccaaaatccagcgaggcagtcaaactttgaagctccaaaatgatctcctgtgactccaggtctcatatccaggttatgctgatgcaggaggtgggttgccatggtcttgggcagctccgtccctgtggctttgcagggtacagcctccctccaatctgctttcaccggctggtgttgagtgtctgtggcttttccagatgaatagtgtaagctattggtagatctaccactctggggtctgaaggacgatggccctcttctcacagctccactaggcagtgcctagggactgtgtgtgggggctctaaccccacatttctcttctgcactgccctagcagaggttctccatgagagccccgccccagcagcaaacttttgcctgggcattcaggcatttccatacatcttctgaaatctaagtggaggtttccaaacctcaattcttgacttctgggcacccacagggtcaacaccacgtggaagctgccaaggcttggggcttccaccctctgaagccacagcctgagctatatattggcctctttcagccacagctggagcagctgggacacagggcactaaatccctaggctgcccatggcgcagggaccctgggtccagtccatgaaaccactttttcctcttgggcctctgggcctgtgatgggaggggctgccatgaaggtctctgacaaggcttggagacattttccccatggtctcggggattaacattaggccccatgctacttatgcaaatttctacagctagcttgaatttcttcccagaaaatgggtttttcttttctattgcatagtcaggctgcaaattttctgaactctgtttcccttttaaaactgaatgcctttaacagtacccaagtcacatcttgaatgctttgctgcttagaaatttcttccgccaaataccctaaatcatctctctcaagttcaaagttccacaaatctctagggcagaggcaaaatgccaccagtctctttgctaaaacctaacaagagtcacatttgctccagttcccaacaaattcctcatctccatctgagaccacctcagcctggattttattgtccatatcgctgttggcattttggacaaagccattaaacaaatctctaggaaattctaagcattcccacattttcctttcttcttctgagcctttcaaactgttccagtccctgcctgttacccagttccaaagtcacttccacatttttgggtatctattcagcaaagccccactctactggtaccaatttactgtattagtctgttttcatgctgctgataaagacatacctgaaactaggaacaaaaagaggtttcattggacttacagttagttccacatggctggagaggccttagaatcatggcaggaggtgaaaggcacttctcatgtggcagtggcaagagtaaaatgaggaggaagcaaaagtggaaacccctgataaacccatcagatctcgtgagacttacttcactatcaggagaatagcacgagaaagatcggccctcgggattcagttacctcaccctggatacctcccacaaaatgtgggaattctgggagatacaattcaagttgagatttggtagggacacaggcaaaccatatcactataccacaagtttttttaaaaaaacaaacttttgagaatcttgtactgataattaatatctggtctggaagtgaagcacatttctttttcttgcaactgattggccagaaccagctagatggccccaccaagccaacattgggggagaactgaaatatttggcaaacagcaaccatgaccatcacagctggaagttctcagtctggaactccttccccaggcctcccatttctggaactctgagaacaacaatccaggaatctgatgacatcttttcctttactagccaaaatctgatgacattttttcctttactagccaaaagggagaacaataagcaaataaattcaattttctcccatttatacttttaaatctgagaacgaattgtgtgtttataagaaagtgagggttgagcatcatgaagaaaaatataaagatctttaaaaagtatatattgggcctattagctacaaacatggatcattattaatatgtgtctgactgacatttaaaatgcataatcaaaatcaagcctgttagatacaaaattcatccattaatagcaactaaatttcattaggtaagtagtagtgctatgtttaaaagagtaatctatttggaaacaggaattaatactcagaatattattattaatatatttgaaaattacttgtgtttatttgtcccagcccttacaaggtgtgtggtaatggttaaggtatttctcctctatatgcctgagttttcttctttacaaaaggggggagggaataatagcacctgattttacttttgttgtgaagattaaatttgtacatatataaatctatatatctatatatacacttatatatgtatgtaaaatatgtaggcttgtgcctgacattaaatactaaaaaatactagctattatttttatcctcatattatcagatatgacacattcataatttaaacagaagcctacgaagaactcataaattaaaagaagataatcttttcacaaggtaacaaattttggaacaattttttagagtctctagacatctgttactgacgttgtgagtgaaatgggtctgtgaagggaagatacaggtggaactgggccagtgtttgcagaggaccatgatatttctatatctctgctggctccctatcagttctagagctagttcaagtgaagcctccataacctctggacaataaaaatgcaccatgctattgttagcatgatgaatgaatttatttttgtttagcttacagaaagttagtagttttcaaaagggtctttatgtatacaattgaagatactacattcttgaaaaggaaatctttacagcatacaggtccctggcactaatacctcatttctgggcacagcttgatatggaggtatagtttgtgttttatctgaggaaaatttaggttggtgttatgttttgggctagctctgctgaaacattattctcttttcttttagagccagggctgtgggctgtgtcacttgtgacttggcagcccttaatggggctacatgaggaagacatttccttacatgattccaagagtctttctctggggttctgaggtagtctctgtgtttcttggagatatcgttggctctaaaatttcccctaagtgaggtgatattctgtcatctcatgcatgggttttggaggctgaggggtgtctgggttggctccaccacctaccagttgggtaatattgtgtagttttttttttaaacctttctcagctttagtttccttatttgaacagggttaaaaattgggcttgagagaaggattagagataatattagtagatattgttgatgaattgggcgaagcagagggagggggcaaagttgactacctttgtttctgtctcaaacaagtaggtggtgatgcctttgaggagataagaaaagtgacttgtgtgtgtgtgtgaaagacagacacacacacatatatatatatagagagagagagagagagagagagacttataaattttggatatatggtttcaaggcacttttctggatgcataagtgtaaatgttcagttgaagttttaatggtgcttaggagagagatgtgaacgataatagagattccaaaggcctttacatcaagaggataactgaagctataggagcagatgaggcacacctgtaaagatgagacaagaagaaagcctagggtagctctgagaactttgctatttagtgtcctcatagaggggatggaggattcttcacaaaaagttcagttttgtgacaccacattcccctgattttactcttacctcttgagacaccaattttttaatgaagaagaaaattatgttgcctgcttaaagtaaggaaagcaggtgttggtgggattccttaatagaaatatagaggtttaaaatacctacaagagtaggagatagaattgatcaagtaaaaaaattgaagagattaattgaggacttaacatcagagaccatatgtttgttgtgacaataatccaaattattgtaataatgtgtttaggagtatttagccttgtaggtaccaagattgcattgatcctgtgttaggagtttgccaggtgtgtgcaatagtgagaaagacatgaagggatttgaggttgctgatgagtgaccagtttagatgacaactactgtttcttcaactctttcttcaacttcaactgtctgttttgggaaaggctagtggcctgtgaggaaacgaagaccccggagctggaggactcaaagagtttggagagcagacgtgtgcaagtgagggttttgtgagcactggaggacaggcagctggggaagagagtgtgttatttgcagttatgatattgggtgtggagctatttttggtggcagcaaagctcaggatgtatttttttattattcccataggtgatggaggctttttattttgccacaaaaccactggtgacgttgcctgtggccaccttggagaagacactggaggtacacaggatgtatccctggaagtggcagggggtataagtttagtaggagatttgttactgagtatttaaggtctaggaacagattgagggtgttgggtggattgcccactaagacactgggttttctagcatgatgacagaaattggagtttggggggagaagagttctattgtgtcttgaagaatgtgatcaggaggtatttctaatgacacaaacatagaagtatacacactggtatagtcagatggcatgagtaccaaggtggaagtgtggtggtcctaaagtggcattaaggagccaataaattgtcattcctaccttagctctgtgtcagatgaaatacacagcatagtgtggggagaaaatgttgggcttattggggatggggtctttcacataaaggaagaaggtttcagaaggcatagtggtatgaaaagaggagaaaccaaagggaggaaggtcaataaagggttaagaacgaggggaggcaaattgactttctttcagcatatgaggattataggaatggaaaccttaattggaattaattgaccacaaatattccaaagatggagtgaatcagttcgagacagagatatctgagggtctgagggtctgaagtaggatttgtcccagtcgtgtgtgggtgggttcactgtgtggagcctggggtcttgaggatctgaacatgggctgcctcctgtgtgcacggtggaggcatctggcctgttctccctggggtggactcatgatgagctgagtggccaaacacacaatggttttcatttaacatctcatttctagcctaacgacaaacctaaaaggtgggcataacaataatgttaataaaacatctgcatttctcccatccttggagttgtgaggatttaatgcaattgtttgtgggaaagcactttaacaactctaaattacgatatatatgctaggttttattgttacccacacctttgatgtatttctctttgtactcttcactgtatctgtaacacattccctaggataattagggctaccctttaacaaagccaagattctatttatagtggtaagctggcacctgggctgattctctctagtgattatgtagttttgatgtggactggcattcttccctggagtttgagtacctccgtcagcacttctcccgtccagaagttccatctctgtgtttttctattacaaagcccagacacccatctaggccacccaccaggttcctctttccagtcttaaggacatctttagctcctggctcatttgtgagatggagtggactgacatgccctaagcaaagattgccagcctggtctagttttccaggtctcccttgactcgacaataaagtaaccactagactttgagaattgcagttttacattgtctagagtcttctagactttcatgaagataggcaaatatgattctaaccaagatgtattaatacctcctacttcctttgaaatgtaactgagactgtacttgagacgttacaatttcttggaaggggaaaggaagcttctgctattgaacgaactttttgttaaggtagctcccaagcaggttcagtagctttgttctattatcacttttctactgacagtgatttttttcctttgaaggcctgggacatggagactgcttttctgcagaaaccacatcccttggagtaatgagctacacctacctcaattattcagtgcagtacaacactccaggtcagctattaagaggtgcacacattatttttagaaaatgtgagtcagtcttggggaaaacaaatctatgctatatgttctttttactcacttgatttacaacatactgtgatgtattctttttctattcagcatctttttgtacccgtagctctttgttctgagcataaatgtgaccttttggcttcaggtagaaactctgtctcatgagcactccctggacacggaagttctttgaaatagcattgattttgtttaagccttcatgttcccctggaaggctgattaaccttagtgccttctttctgtaatagctcatattgaattatctccctctgtctgattatatccatttgaatcacctgcaagtttcttttacatgtctagagtgaggacaatgtgggtgatgaagagctgaaatcttctaggtaaacattagatttttaaaaattctatttttttttttttatttttaagacagggtctcactctgtcacccaggctggagtgtattggcatgattacagctcactgcaaccttgaactcccaggctcaaacctgagcagctgggactacagatgcaccaccatgcatggttagttttttaatttttttttgtagatagaggttctcactatgttgcccaggctcatctcaaattcatggcctccagagatccacctgcctcagccttccaaagtgctgggattacagacatgagccactgcactaagccaaaaactcttgttcaaattacattttctgccttagtaatgctgctttcctagcttctgagaatttctaagacccaatggtaactctatgctaaaattaaaatacgaatgtccttttcaaaactgcacaatatctttgctattgtcaataatgtctcaataaacataaaatagcaaagagattgtgcagttttaaaaagaacattcgtattttaattttagcatagagttaccatcgggtcttagaaattctcagaagctggaaaagcagcgttactaaggcagaaaatgtattcacaatagcaaagacttggaaccaacccaaatgtccatcaatgatagactggattaagaaaatgtggcatatatacaccatggaatactatgcagccataaaaagggatgagttcttgtcctttgtagggacatggatgaagctggaaaccatcattctgagcaaactatcgcaaggacagaaaaccaaacactgatgttctcactcataggtgggagttgaacaatgagaacacttggacacagggtggggaacatcacacaccagggcctgttgtggggtggggagaggagggagggatagcattaggagaaatacctaatgtaaatgacgagttaatgggtgcagcacaccaacatagcacatgtatacatatgtaataaacctgcacattgtgcacatgtaccctagaacttaaagtataataataaacaaaaaaaaccactgcacaatctctagtattcagatggagactaagcatgatttttcttataaaagagcagatcagaatgttgtatcttttattcagaagactggagttaatcactgttatctttagtacttagtgctgccaaggctgtgtgttcacaatgaggataggatgtcaaataaatgaagcttcatagaacaagagcaggattgagtcatgtaggcaactgtttcagcttcctcacctaacttagcaccaaaatgtgttattgtcattacagagtgcttatttaaagaaaaataaaaagaacacacacacacacgcacgcacacacacacgcacgcacacacacacacatgtagctacatgtctaggaaggatgtggagagctgaaatatgaaggcaaaataaaacatctttttcaaagtatacagcctacagtggttagcacagagctggccacatagcaggggtttcataaatgcttgttgattaaactcttttttttgaaaacaataatgtagaagcaaagagcctaaagtgttttcataaatcttaagtggtagctttatgttccagttcagcaaaacacaaatttgaaggcaatctgtacgttagggttcaggtgaagaaggcaaaggaatcaatgaaattgtaaaagctttccaaatttgccttttctcttaagattgtctttctctcattctcttctccctatttcaggaatgcaaatatcctgtttcatcaatcttttgttttctgactcaagataacaacaataatttattgagcacaaaccatgacttttgggtctgtgtagccccgaagcttcatagttcaatatctgacacataagaggggcttactctacacttaaatgttagttttgtcctcacttttttctctttctcagagatctcccttttcccctacttgtataagcatgaagaaatctttcttttcattctctccaagtttaatcagacaactccacatacatacatctttgttcacaactatgaacaagacagaaaagttgctggacctcaaggactttacaatcaatctgggaaggcaaacattgaacatataatgtccagtctgataagtgttagggaaggaaagctcagaatgcaagggaatataatctaatctaggagatcgtgggaaatatcactggggaatttggaactgaaagaaaaataagatttgattaggggaaattgaaggatcagggagtcaggcggagaagaatgtcccggcagatgagacactatgtaccaagcccgagtttgacagagagcgtggtttacagaaggaatctaaaaggtgtagtttctgtagcagaagtgtaagggtgttactcgtaggaggcctctattgaactcttttccagtgacgtagtgtgtggtctttaagtggctttgcaatgatagtaagatcagcattgcattactgaatgagctcctttagtaaacgtggatatgtgctttctgaatctatttgtttgtttttcccaagtcataaacagtgaatcaagcaaatgaaacataatcaagcttggatagtatcttccactaatttccttggtcttaagtaagactgacagtaaactgatggtcaacctgttcaatgggctttaacaagtagtagccacatccaagtcaacaaacagtacaggcaatcagggcccctggcctacagtgaatcatgggaattaccccagggacctatgctttggggactcgtccttcctggcagctatagatgccatcagaaactcatttgcacactcttataaccaagataagggcaatggttagtcccctgtcattgcatgttagctttctttcccttttctaggctttttcagatgcctcttttacattattacttttcctgtgtgaaaataatgcgtgggaaatgggtaggtcatacagagcgataatttcattcctgggcccctgtcttgcagctccctaagtaaagttttgcgcctggcactcctctggcatagtaacctctgacaaacccttgggtaatagaggagtagcaaaacccatgggtaatggaggagtagcaggaatattatgattagctaacaaattcacaaagtacatagaaatttttttctcgaataaccactatagctgaggaatatagattagtgacaaaattgtgcactcaaccaactctattaaaagtatttcattattcccgtgaaaaaactcctaggaaaatgattcactgagagatatacgattgtataagtattgagaaacagtctttcttttttgctttttatttatttatttaatagacattatagttacacataattatgggatacaatttgatggttcgatacatttttatgttgtataataatccaatcaaggtatatttagtgtactcatcacttcatgcatttattattcctttttgatgagaacattcaaaagcctctcttctagctctttcgtaatatcaataccttactgttaatcatagtcactctactgtgcaatagaatgctagaatttattcctcctattgaattgtaactttgtacctgtcgaccagcctctccccatcttcttccccttccttcttgcttccccagtctctggtaaccactgttctattcctttttttgttttttctttttgcagagttcgctctgccgcccagactggagtgcagtgcacaatcttggctcactgctacctccgcctcccaggttcaagtgattctttctattttttgggaatgtgcgttatctaatacttaggtgcctcagatttaatggtggtaaatctcactcattttatgaaaaccaaatgaacactatcctcacaatggttagaaagcaagatcagctcaactttatgaaaatatgactataaaaccatttattattgccaagtggttggagtggagttgacagaaagatgcattattttaaattgtgttttagatgacagaacaggagtcagtaatgttccagtttggaggaattagagttaattggttaattgattgattcgattcagtcaaatttattgaatgactgctgtttcagacactgtatttggtcctgggaaaacacagataaataatatataattgtattataaattaataaaatagttttttccctccaaatgtcagtagtccttggaaaggacatgtaaacaatgaatataaagtgacacatagtccagtcaagataggtaggaaggtctaagtacaattgagtggtcaatttcacttcagggaagggcaatgatcagggaagatttcccagggaaagtgatgcttgggcaaataagtaagcattttacaaagagacaaggaaggatagggcgtcctgggcagaggaaggagtgtgtacaaaggccaagtgacatatgacaacattgtacatgaaggaaactaccatcaggcagagctgaaatgttggcacatggtgaagtgctagttaccggtcccagccatgacagtagtgtaacaaatgcctgcctctggtgcacagcaagatattaagattcctcaaaacagttcatatattttataaattaagatagacattaacagaagctcatagaatcaattaatgcaaatgtaagtgacctaagaggcattttgttcagcatagttattgattttgcctgacccagaggatttgaatttaggaagatgtaagcctagagtagctgtcagttatcttgtgatacatgggccttggaagcaaggtacagggacacagtggaccaatgggggaagattaggtcctggtgatgtgattcaagccactggattaagccacatctgaaacgtctatttctgtactcttcagttacaagagatgttagtttgaattatttgcttaagtcagtttttaaaaaattcaattgcaacttaggagatacatctggcctcttcattttacaacttaggagactaatatctagtatgacaaagtgacttgccaccaaatggctggttaaaaactgataccaggacccagatctaatgactcagaggccaggcttagaaatatctagctttttttttttttttttttttttttttttttagacacggagtcttgctctgttgaccaggctggagtgcagttgcgcgatcttggctcacagcaaatttttaaagcatctacatgtgagggcctaagtatacgagtacctagaaatctattttgcagcaactatatatttgatagagtgattgagtttagtttaaagatgacatttctaagtggtagtgctgtcaaaagagcattgcattgaatcaagaatctggcattctgtgttcatagttcacttttgccactaattatttttgtgaccctgggtatttctttctgggactgtattcattggatatgagtatctctaaatcttcttcaacttctatgattctaaatggaagtacactcaattttcaagtatccattgtggattttatatactgctatgtatcctgagaaaatcttccttttgaattatttttcgtattaatgagttcaacttcacaaatatttactgaacaccaactatgagctaggtgatgtaaaagtgaatagttacttctagtcagtattacttacttacttttgtattccacagtgcagtttgatattgtttgtagttccaaagcattaaacaatgccttttaatctaggacatgtggaatcttcaaataagagcagaattacaaagagttttagactgccactttgcatcattctgagaggcaataccataagtgttcagcagtcagaagaagggacaggggaaagtcctgagcagtgcaggtggattaagaactaaatatgcctacaaaagcacattcatgcctaaatgtcattgcatttggatcacaggccttgagaagatctgtaccatcactgtgggtaacttgggcccatttagagtacttgcctctgagggaaataaaaatttgctagcaattttctctaaatgacattatcataggcacttaattccttgataggttcttttagataatttttttataatgaagcaattaatttgattcacgaaagtaagtttctagtttatataaagaccagatctggcctatttcttagcttgtctacatttgagtagttccattgctggaaaatgaccctggagcttttcaatctcatttgaagagtccaggggacagacagagacactagttatgcagtttactagagccaggttccatttcatctctaataatttttgcctgtgtgcgcctgcacatgtagcttaagctatctaagccttagttagttttgtcatcagtcaaaggggaatagtgatatctccctctaagggttgtacaacatggtggttatttatagcacagcttgaataaatgttattagatgatatagtctcagtcaggttttccttggaccatgttttagtgacatattagactccaaagaagcaaaatgctaggagcacaaggcagcctaacttgtgagttgatgtacagtgtgaagatgcaccacagatttagaatttcagttgactagaagaataagtggtagaatttgtccctggttgactactgtcttaactttgtgtctttggggaaatatttaagctctccagacttctatttcttcatgtttaaatcgggaataatattcctttctcatttcgtagaaattgaaaggagataagtatgaaagcgtttatgagagtagaaatcatgagtgtgaaagttcatgctattatggcacaattgatgttgaaagttaatattacagaccattccttttttgcacagtgaaaattgttttatatccatattggcccctgtcacatattaaaatattattttctcttattaatttctatgagaataatactgccttcatacttttataaagggacctaggaaaccaatatttgtctaatgtttcaggctaaagagtaaaaaggaataggtatactcttgaaaatagatggctattgtcaatatttttcctaccaagaaaataattccttctctataaagaactgttactgtttagagcaatattttcacgattcaaaaagattatctgagcatgtgtccaaccataactgacccctgcaaaatatttctaaaagcactgtgcatctaggctgggaagtatgcaaaattagcaaaaatcccctagcattttcacaccaagccatgtgtatttaatatacaccacctcaaagaggaacattaccaccctagcactatgagtgaggtgagacagagagatttctaagaatatatgggtgtaattttctgttaactgagagtgattgacagttcgtggaaatctgccctccaaaataacctgttttgcagcacccttagttttatttgatatgaagaaactgcctgctgttttgacccatttagctactaggaactctatttactaccctaactgcctaaatccctatggataaattaggcagtatctgtttattttagtttagatttatttttaaaaccagtgttcctttgactgttcttactatttctatttgagagttggttgaaataagatcatgtaaataaaaatacaatgtagtctagatctaaagtcactgtacatacctagataattttttttttttttgagacaggatcttgctctgtctcccaggctggagagcagtgttatgatcacagcttactgcaacctctggctcccagattcaggtgattctcccacctcagcctccctagtagtttggactacaggtgtgtgccaccacacctggctaatttttgtatttttgtagagatggggttttgccatgttgcccaggctggtctcgaactcctaggctcaagtgatctgctcatcttggcctcccaaatgagaaggattacaggtgtgaaccactgtgcttggcacctagaggatttcaataaaatttgaggtcctataattttaagatcacatttccaaaggaaggagttttgcttcttttcaaatgcatggacaatgagcaactatattgttttggtaaaactagtagtcccaaataagaaagaggtcctactagtccctagtagtctagtcccttgactagaagaaaaagtcaagcccaatttattttatctgcaggacttggtttaagggggattataaaactatcaccacataaagtctttgatgaagaggacatagggggatgtagggagtacttcagagatgcatctggtcactctcgaatacataacacatttacataaatatatatatccaagtaaacttcagacttcacatatttgtttccttttgtttccttgttgaaaatctttatccaagctgacaatcacagtacactgctcatgtagattccactgctgagagctggaagctgagagtagagtgggctggggagcgactttcttgggactattatgcttttcttgcactttactaggttcctgttcttccccacccactacctctcctgggcactgattccaggcaagtgagatgcatatctgtggactatggttaagtgaaagcctttgttctggaaagctctatctggtttctcttaagccagacagaccagcttgccatgaaggctttcataggctctggtccacactttagacttccaactggtctgctactgacattctaggctattgtttctccaagtaatgaatgagtataccattggtggtggaagagagaattttagatggtacatagacaaatgtttttattgtgattgttatgtatttttaattcatatgagaaaaatgttttccattcatggtagcaatatacagtttcttctttaaatacatttacttaaaaatgtgagttgatttaaagagaaatattaataagacttctggggaaactcaggcatgacaaaatacatgaaggtgacatgtgagtagttgaggtttagaaagcactgcaatgttatagactctaggctagctccctgcctatccccaggccagttaactagttgaattctctcaagagtcaggatgtctttgcctgttggccttcaccttaagaaagtcaggcaatgatgaggaatcacacctgaggagattgtaggagacctttaacttaaagagtggtgatgaatatgaaagaaagagtcatagtatatgatcaaagcagagaggactttgagactcagcgattgggatgtaggaaggtttcctgtaaaaataaagtcttaactgggcttcaaaggatgaacaggaattatcctgtggagaaaagtaggagaagaatgacatatgccaagtttgtttcttaaaaccacaacccccaaattgtgagctctgggtcttaatttggtggggatgggaagcgccaatctatctgtgacttctttcctgacatgggctttcaagtgcatgtaacttgacatttatgatttcctctgcaaaagaagaaaggaacagggtgatggtgcctctgtgatcagttgcatttatgggtgcaacagcaaaggaggtgggacacctaagggacaaccgttcacgtgaaatgaagcagggatgagaagaaatgcccgtttgtatttaatacatcccagaaatgaacccctttattttctgggactgttagagcagggaaactatatatttctaagaatgggggctctgctcaaatctttgtattacagtacaaagaagggtgaggacaggaagcagtggtgatcttgctctttttggaagagtttgtgtctgtccttttaaagtcaggtatgattgataggaaagtcaagtactggcatcctcagattggagaggttttattttattttattttttttaatggagtcttgctcttgtcatccaggctggagtgcaatgccacgatttcagctcactccaacctctgcctcttgggttcaagcaattctcctgtctcaacctcccaagtagttggattacaggcacctgccaccatgcctatcttaatttttgtatttttagtagagacagggtttcaccatgttggcccggctggtcttgaactcctgacctcaggtgatccacccgcctgggcctcccaaagtgtgggattacaggtgtgagccaccacacctggcctgagtttaacataaacaaagaaataaaaataatataatctctcaaaatagcaaagaacagggttgtctaatcaaaatatataactatttatttttaatagccacattacaaaagtaaaaagaaacaggtaaaattaatttaatttaattttaaaaatatattttaaggtatacaacacggtgctatgggtaaaatggttattacaatgaaacaaattaacatctccatcatctcacatagttacctgcttcccttcccactccaaacccctcattgcaagagcagctatagtttactcatttagcaaaaatcctgaacgcaatacaccatttttattattttttaaatttatttttttgagacaaggtctcactctgtcacccaggctggagtgcagtggcgcaatcttggctcactgcaacctccacctcccaggctcaagcaatcctctcacctgagccttgcgagtagctgggactacaggcacgggccaccacatttggctaatttttgtagagacagggtttcaccatgttgctcaggctggtctcgaactccttgggcttaagtgatctgcccacctcagcctcccaaagtgctgggattacaggcatgagccatcatgcctggcctacaatgcactaatattaactatagttggcaggttgggcattagatcttcagacttgttcatcctacatatttgctactttgtatcctttgaggtacatctacccatttcctccacccaccctacctctggtaatcactattttattctctatttctgtatatttgacttttaaaaaaattctacatatatgtaaaataatgcaatagttttctttttgtatctggcatattttacttaatataatttaaataatatacttcatttaactcaatatatttaaagtattttaacatacaatgaatgtaaaaatattgaaatgttttgcacttttttcatgtaaatatttaaaatttggggtatatgttatagtacatgccatttaggacattaaattgccaatggaaataatattcagattttataacatttgcagttgaaaaagtagatacatgtatccaagttgctctcaacatacttaaagttttccaataactgaattaaatatcagtttatcagtttaatataaacaattagggtaaatgaaaataaaatttcagctctttggttccattagccatggttcaggagcagaatagtcacctgaggctagtgacaacgcttttggatcacaggaaagaagaaaaaaaatcaaaataatttttcttggtcacatttagctccttttcttccaggatgattacggagctaggaatttcctacgaagctgggtgataaaaggacattggacaaaaacacagatagcttcattctataccaggatccatcactgattagctgtattatatttgtctctactgtaatttgaggagaatgatacctgcttctctatcttgttgggttttacagatgatgtattgaaagttcaataaaatctataaacaatagatctctgtggcttgaatggtcctcagatatcttgaccaatgattctcaaatgcttaccatagaccataatttttccccacatgacactgcttcatatttttaagttttttttcaccaaatattttgttttactatctccaagccctgaaactttttttctccctcaaacatgacttcaactttactatcctggtccctttctattgaatgtgttttgtttgtgtctatatttcttatagtgtcttgaactgattgtacttacgatatgacttgactagcataagatagaatagggcagtcatcttctttgatctagactagatgctatccttctattaatgcagttgctagttttgtatttgcttgctttcaatttttttttttcagattttggtaaccactgttacttgactcgtatcaaacttatcagtagctaaaacccccattttccctcttcctgtgcttatttgactagttttgttgcgctttctgaaatgtttctcacttgtttttgaccaaaaaaataaaaataacaaatgccattgattctgtgtctatactatttgaggcagttaggcctttacttacttcttccaacattttaagcagtgttgcattcaatttgaacaagaggaataaaaaggcttgagaaatcttagggaagtgtgtctcaagctttagcaaacaaacaacagatctgcaggagatcttgttaaaatgctaaattctgattcagcaggtctggagtagggtccaagattttacatttctagtaagtttctatggattatgttttgagcaacaaattcttagagtgtctgaaaggtttttaaaataactgatttcccttcaaaatcttcttcattaggagtaaaatatacatcttctcactctgtaaatcagctctgagatcttctataatcttagctgaggtttgggtatgcagagttttgaaactcttatttgcttaagagaggagccatgtatgatcttcttttgggtttccccattgtctggtaaaatgaggagcattactaaacggcactcacttttactgagtttgtttggatcccacagagaactgaaaaagtcaccattatggaagccttatcagagagatggggacaagtcgccccaaagcagttgtcaatatctggaagatatttttctagttggccttatatttcatttctattttcctcagttctaattcagtttatcacaattaaaaagaaaccaatgaaaaacataaatattggagatcatttgatttcattggaggctggaaaggatagaaaggctgaaaagtggccgggtgcagtggctcacgcctgtaatcccagcactttgggaagccgaggcgggaggatcacctgaggtcaggagttcgagaccagcctggccaacatggtgaaaacccatctctactaaaaataaatacaaaaattagttgggcgtggtggcacgtgcctgtagttccggctactcgggaggctgaggcaggagacttgcttgaatgcaggaagtggaggttacagtaagccgagactgtgcctctgtactccagcttgggtgacagagcaagacagagtgtgacagagcaaaacaccatctaaaaaaaaaaaaaaaagggaaagaaaaaaaagaaaagctgaagggtgtgctgggtcctgtcctgggtgagggaacaacttgtggaaaagtgaattgaggcttatcggaatgtttggggctcctcaataatgttggcactctgagatacagaccaaaagtgaggtaaaaagcgagtgtttcctttttttcagaataggactttactccagattttcttactcttctcttgattccttcaccatccttgatcgacattcacctcagatgcccatgtcccttctccaccggcatagcttgttttcttcttaatcttcttgtgttcatctagcctcacattgcatttgtcacacttcgttgaaaacctactgtttgtcaaagtgtctttctagtaatccagatatctcttcccccatgcctttggtgtggtttcggtagagtcatacagagcagcaatgccttatgaaaacgaattttacagaatctgcctgttcatcaaaggaggccagacaggaggtgagaaaaaccaggtgtgtcccacaccagtctcaatgaagccttttggggtgtcttgtgctcttgactaaatctcagatggtactgaatgaataatcaccaaaggcgtgagctgttaaggaatcccagtttggctggctctgtgcagtcagatgtagccagccctgtttatgtgtgaaaggattgggttttccccaagctgtttggtaatgttgcaagaacagactttcccctccctggctccctggagtaaaatggctgccaaagtattttggaacagaaacttagaaatgtaccgaccactagaagagagtaacaagggtcctttgatattttccgtgttcactatgatcaagctggcatcgtttccttctgagctaaagattctgagctatcattggctgatgtgagcttgtgacctagctacttctgttcacaatacactgtggaggggcagcgggggcagccctatttgggttgagagtctttaaggagagctttacagatgagttctagtgaagcccatcagggagaagaaaatcaaacacaatgggaaatgtttaacaattaaaaccaggctttgcctgtgtggtcctgtgttttaccacatcactctatggaaatgggctgttggaaggaagactgtatttctgacagtttgcagagccaaaaacctgttgaaggctttttgtaaggtagtggagaaaatggcaaaacctttaaaacttaagggaaattacttgatagttctgatgaccacaggccaccagactgctgggtcatggaattatagctacatgacaaagaaaataggagggtgggctgagccagactcagaaactattccaaaagtactatgactttttaggaagctagttctttttatttgaaatattttgtgtttttttgcatgagaattagcctatgcttcttaaaaatatcataaaatgtcagctagtagaaaaataaagagtttaatctccactccgactacctagagtcaacccttgttcatactgcagtacatttttttcttttagttctgttctatgctttaaataaaaatacaattaggtccatatggcaatataattttgactccttttaaaactgtagcttatatcataagtctatttgatgttgttttgaagttgtcatgtacattttgtcatacaagtttttaatgactgtttttatggggttgtgccccaagttacttattcattcccatgttatcagatattttgttctttagctttttttttttttttttttacattataactaatgaggcaatgtgtcttgagtattttgaattaactctctagaatcgattcttggggaggttatttactttgaagtgatggacagagtgtaggagatttatgagtgaactcttgtctgatttggaaatatagagttgtttaggctaggtattaccaacccaaagttgacacttgagtcacctaagttcttctctactccagagacttggccctgcctggcctgatcccaggaaaagagattttagggattacagaaatgggaacaagttgtgggtctgagcacagcatgcaaattaattcaacacagcccctgggacaggcccatgatcagtgagctgaaactcccccttcaagtgctttcatgattagactccagcctaggaagcttgtctattagttgtgtaatcttgaaaaaatctctgacacttttccctctgactcagtttccccatctggcacccaatcttttacagtgttatgaaaaatagggaaaatgtagaaaggaagaacatggcacccaatccttaatggacactcagtgaaagctggctatcatcatcatttttggggttgttgtgttctacaaatgtattttcccaggagttttttttactctgtctcctctttccttcatatacccccagcctgtggctggggtcttgcttcaaccaccatgcacctttctgaaacccaagttttactccctgataaaggtattgacctcttgttggtctcatcctccagacctacctatacttaagaaaatgacatctctttaaactggtccccagttcacttgttttccctaacattttaattcacaagattaatcacttcccttacaggccagtcttactgcagagttgatttttataattttgggcctgttggtctggttgtacttttctctttctgctggtctgctagttatagcgggtcttgaaagcagtgatatgttatgacattgtcatcaccctcattattgctctttatataacagtagcagcataactgtgttttgatttcttgtacaaggcataaagtgtgctagtggctcactattcacatcaatctcatcagaaaatgttatttcctccttttgttgatcatgatatagaggcccagtgacattaggtaacttgctcaagatcacacatgtggaaagctacagagccagacttggaactgagtccattatatcttaatcccactgcactccaaaatttgttgaatgaaggaatagataaacgtatcatgattttgatgttctgactaattcgtagccagtactttattgctatcggagcttaagctttaagtactggctaggaaatagtcagaactttatttttaaggaggagcatataattatgtatattttatacctgtagtaaattgggaactatagaaaacatgtagaggattgtgtttaccaacttcatgtagagtgaggatacccgactctagcttgctggtagttaggtaagtcagacatgggcaggggataaaccaaattagactatttccatttgactaagccatataatcaggtgtaagccacggaaagaaatctggaaagacaggtgcaatattagaagatggctcatgatagtgatcattagaggttcaggcttgagaaagccaattggaatcaagaaggcctaatcctggggttctgtcacagaaaagaaggctggtagcaggaagaggacatgtaacatgaattacatgattagatttgtgtcataataacaaaaacaataatgataataacactaatagcttgttatatgccatgccctgtactaagaactatacgtatgttatcccatctaaatcacatttaatagattcccatttttctcatgagaaaattgcatcatacagagatgaactaacttgctcaaggctatagacctggtaattagcaaagcagggatttgaatttagatgtatttttctctgaaggctgggtttagataaatggatctggaagcactgggaaggatgaattaatgggatggagtgcaggggatgcagagtgcccacttatggaatgatttcattcaagagagacaggagggtcagaggtaagaatgctaccgctgggacagagaggaaggtacagatatgagatatggtaagaaggtatactacaacagtggctcccaaatctcaatgagtagccagttctcatggaggttttgtttttatttttgaatgaagattcccatggcataccttgaatattctgaatcagaatctctggaatacaacttggtattcttataaagcaccctaggtgatgctgaagctctgccaggttcaagaaccacagctcgatcagcctatatttagatgtttggggtggagaatgagagaaagaaaagattttagggtggcatccaggtttctgaattttgtgactcagtgaagtttttggagggtaggtaagatgctgagttcagttttggatgtgttgagatggactggtcctgtggatttagttggatattagagtctaacgcttagaacagaggtcaaggctgtagatttagatatggaggacactggtgtttgggtggtgatggcgctatatattacatggaattttcaaaatactcaaaacttcagttttccctcaataattaatcactttacatctttgtgatcttaaatctctttctgaccattgattgaaacttttgcttttaaaatttacattacctttcttaacagttccttaagattcatgcattgttgtaagtagttacttgcaccatttcattggattcacaccaacaattgttaaagtaaaatttatttttcctgtgttttagatgaagagatttaggcaggttatgtaacacacccaaggtaatatagtcaaataattgagccagaatttgagcccaagtctctttctgactctaggcttagagctttagggctatttcacaaaagggctgttcctaggtcaggcatgacaacttctatattaccttcgtaaaagaagcaatataatctaccactattaaattttgcaggttaattttatattatgtttaaatacagaaaactttatttaaaactcagttgaatttctcttgagaaattggccatgtagtaaattatatttaatagaagagtttgtgtacttcccagggagcagagtattggcctgatcaaagcacctttcagcctttgtctaacagcatgtgggtaggctacattttttttactctcagagaaagggggtgggcaggggtgtgatatgggtttttgtctctgggagttctgttgcatgatttgacctcccaaattgttttgtggggcatatccaactttgggttgaaactaaaatgggttcttggtaatcccagattgaaaatatgtctcagcagtaacattgtttatctttaggtttaggtaaatacagacatttgccatgtcttcttggtagcactgtaagaatgagtagggctgtgaaaaatgcacagggcattcattatgaagactggctggttaaaactgatacactaaagaaattgcattcttttccacaagctgagtcatacagctgaaattgtggaatcatctgagccagcagctgtaatatgatacttaatctccataagtgacagatatctaagataacacgaacacccagacgacaactcaggcaaccccagcacagtgttttggtatgagaacaggagaaatgttagtagagtgaacatttttccacagagaactcaaatatggtaacattctcatagctttgataatccccaataaactgtggttactaaaatgcatgacaaaaagaacttctatctataaagaacttctttatacatttccaatacttgggttatgatcaaggagaaaaaagtttatcagttaattaagagttaggtagctagtttgcccacagattaatttgtatgaggtaaaggaaatctcacctaactgggaaaaagcaagcttaccctcaaggtatgcttatcccaaccccaccctgccaagtgcattccttattcctcaggtgtgcctgtttatcccaaggacctagccacacctacatcttgttctggccccacaccaaggaacatataaaagttccctctctggccgggcgcggtggctcacgcctgtaattcccagcactttgggaggctgaggcgggcggatcacgaggtcaggagatcaagaccaccctggctaacacggtgaaaccccgtctctactaaaaaatacaaaaaattagccaggtgtggtggcgggcccctgtagtcccaggtactcgggaagctgaggcaggagaatggcgtgaaccctggaggaggagcttgcagtgagccgagatcgtgccactgcactccagcgagggcaacagagcgagactccgtctcaaaaaaaaaaaaaaaaaaaagtccctctctttatatctcagggtatcttggagtcactactgatccttgacctccctcctttctctgaccatgtctagacaagtgtccaggtctcctgtgccaaatgtctatttgttgcctggattaggttttgacttgtttttctatttctttgcatctcgtagcccatttctttgattcaatttcacaatctcttgattttgtccttaagtatttggcaacacaaaccctcgagaggcaggatagttcaacagaaagaagatgaaccttgggggtcagaagattcaaacttccagaatttaaatcttcattctgctattactagatttataaactttatcaaatcactctcctactctatcccttaattcaacatatttaaaattggaataaaaatctcaatgtggtagagttattattgagatgaaaatcagaatagatacaaagaacttgatagccccaaggagcttgatcagtgtttgtttaatggcccttcctctcttctcatatctcagttcagatcctactcagccatttattttattctgctccttttggagtagagaataaagccaagaattatgcttaaaaagtagcataattaaaagtatttaaaacacaagtaacttgagaaaggtgagttggaagtttatatctaacctcagttttttttggagagaaatttacccgtcagggccagattaaaacatttacaagtcccaagcacacgtgagatgaagatgcccctcacttatctcacatgtaagttgaaagttaaaaagtgaaaatgtctactagagttcaataatattctttttttcccatgacttctctgaagcttttagaaaatatgaaattcttaaaaacaataacagtaacccacatttttattgccctggtttgccctatcttatctttctcctgctcacagggtctgaggcagctgggataggggagaatgattaccagccaatcaatattttttgaaccccagagattatttatttatctatccatttatttattttgagatcttattttatctggaatcttaataaacgattagtttccaaactgtatctactgtgtgtattttatccatatggcccagatttgtattacttatttgtgattctgaataatattttttccaacattaattatcagcctctctgtgcccctccagaattgttacaacctatgttaatgcacactatggcaagccatgtgaattgcctacgcagggaagttttcttcatacttccttgccaagagaaccccattattggtcagttactagtcacatgatcttctttagcccctccttagcccctgtagtgaatcaggagtagcctaaggccatggtggtaactcccctttttcttggaaatgtttgatttagatatggagaagaggtgcaactttgcttatgaaatgggagggcaaatatgggaaactttaaggtaagttttctttccccttgaaggggaccaaaaagttgtggtttatactttcttgactctggtcactgttgggtgaagagttggtgctatggaagccatcttcagaccatgaggggacaagtctgaggatacaattacatgctaccggtggcagaggacagtatagcaagaaactggatccctgatgacattgaaccattgactgaatctaccctggaaccatcaggaaataatccttagttttttaaagatgcttttagttgtgttttttattacaagtacctgaaagcatcctaactaatcaatgctaaatgcatctctcacagtttatgcttatttttcagaaatgcctagtggaaatttctattgctgattataatatttgtcctaaataaattgaatagactgtcaatcttttgaaaataaaagcatgacttgattagcaattgtttagtctgatgttttcctaatttctgtcatttgcataccacttctttgattttgtcatatccttgtatcatctgcactaatagaaatatttttccttaagttgtctctcctttaaaaaattatatccatttattttgaagagaaactttttcactaactataaattgaaaaccgatatcatttgccttaaatagaagattgtcataaaaagaaatgccatgagtgaaataatgttattaaatatttgccagatatagtttcctatgaagactctgagcttgtggcttgctgtctctgttgaaaggagagactagggagtgttatagaagtggtaaaataatccttccactgactgagactatttccttgccacaatcagaagaactaaaagaaaggaggatatctgttaatatatgaatttatctaaatgtcatgcagtgacttctaaaatcatctggtgtgctctgtttccccttggaggtgacttaggcctggcatcccaaacaatacatactggagtgaagctccaggaaaccctgaggagaagagaagggcttaaagagcaatcagccttcgattgctgggattatgaaaggtcgtaagaagcgaatgttgcaatgttttattatacttgatattgaagcaaggacaagtaataatttattattctctccatgtcagtggtatttacctttttggaatcatgtgccccattgagaatttctggaaaaccatggttcttctactcaggagaatgcacaattgcacacatacacaaatgtgcaagcacacacacacacacacacacacacagaattgccacagaaggtcagtaggttcacaggccctaggctaagaaccagcattctgtatattttacatgtgttctcttacaagttaccgtgtgattcagttcactccaaactgcggttaagtgcaaaacatggttttgaatatttctatcaattagtaagagtggtatgttaatttaaatacaccaaagtggagaattactgtcctctcaatagctactttaaatagacataagttacagtgatattgccttccaggaggcttcaagaaatgagatcaggctctataaaagaaaatcacccaaccctataaagtcatctttatgaactttgaaacaccactgtatgtacctagtaaaaattattcctgggtaagcagactcccaggcctgggtggagttcacatgagtccctttgctaaaataaacagaagtgactgggaactttggattgcctttgtctgaacttgagtgtctggatggatcagcatcagcagcataccacacacctgcttgtccagccaaagagaaacccaaagacttggcatttgttttttacattgtcaactgtgcaaaaatatcacgattctaatttatgagggtccatgagttttaaaaacaccccctgacatttttctagccaaataatttttcctttaaaaggcacaggatgagcaacaagattaggtagatcacttcaatctctaatttcaaaagataatagttaaaaattcaactgtaggactaacacattaactatgtaataagacccagaatagtctttggagcaaatttcagtggatacttgatcaaaataatgttgaagacaaaatcttgaattgatgatatttatctgatacaattatttacataacaaatgttaaaagaattagaaaaatttcataggtaagatgttcattatcttcaagtgaagttacttgctttatattaagaaccacaaaaacttactaaacttttttttttaaaagggtctcactctgtcacccaggctggaccggagtggctcaatcacagctcactgcagccttgatctacccagattcaagtgatcttcccacctctgcctcccaagtaactgggactataggcacatgccaccatgcctggctaatatctctcttttctttttttttccccttattttgtagggacaagttttctccatgttgctgaggctggtcttgaactcctgggctcaagtgatcctcctacctcagcctcccaaagtgctggagttataggcatgagctactttgccccctagcagacgtcttacttttttttttaatttggtattagattgagccaatgactaatttcaaacatttataaattactaaattcttttttttaattatactttacgttttagggtacatgtgcacaacgtgcaggtttgttacctatgtatacatgtgccatgttggtgtgctgcacccagtaactcgtcatttaatattaggtatatctcctaatgctatccctcccccctccccccaccccacaacaggccccggtgtgtgatgttccccttcctgtgtccatttgttctcattgttcaattcccacctatgagtgagaacatgcagtgtttggttttttgtccttgtgataatttgctgagaatgatggtttccagcttcatccatgtccccacaaaggacatgaactcatccttttttatggctgcatagtattccatggtgtatatgtgccacattttcttaatccactctatcattgttggacatttgggttggttccaagtctttgctattgtcaatagtgccacaataaacatacgtgtgcatgtgtctttatagcagcatgatttataatcctttgggtatagacccagtaatgggatggctgggtcaaatggtatttctagttctagatccctgaggaatcgacacactgacttccacaacggttgaactagtttacagtcccaccagcagtgtaaaagtgttcctatttctccacatcctctccagcacctgttgtttcttgactttttaatgatcgccattctgactggtgtcagatggtatctcattgtggttttgatttgcatttctctgatgcccagtgatgatgagcaatttttcatgtgtcttttggctgcataaatgtcttcttttgagaagtgtctgttcatatccttcacccactttttgatggggctgtttttttttcttgtaaatttgtttgagttcattgtagattctggatattagccctttgttggatgagtagattgcaaatattttctcccattctgtaggttggctgttcactctgatggtagtttcttttgctgtgcagaagttctttagtttaattagatcccatttgtcaattttggcttttgttgccattgcttttggtgttttagacatgaagtccttgcccatgcctatgtcctgaatggtattgcctaggttttcttctagggtttttatggttttaggtctaacatttaagtctttaatccatcttgaactaatttttgtataaggtataaggaaaggatccagtttcagctttctacatatggctagccagttttcccagcaccatctattaaatagggaatcctttccccattgcttgtttttatcaggtttgtcaaagatcagattgttgtagatatgtggcattatttctgagcgctttgttctgttccattggtctatatctctgttttggtaccagtaccatgctgttttggttactgtagtcttgtagtatagtttgaagtcaggtagcgtgatgcctccagctttgttcttttggcttaggattgacttggcaatgcaggctcttttttggttccatatgaactttaaagtagttttttccagttctgtgaagaaagtcattggtagcttgatggggattgcattgaatctataaattactttgggcagtatggccattttcatgttattgattcttcctacccatgagcatggaatgttcttccatttgtttgtatcctcttttatttcattgagcagtggtttgtagttctccttgaagaggtccttcacatcccttgcaagttggattcctaggtattttattctctttgaaggaattgtgaatgggagttcactcatgatttggctctctgtctgttattggtgtataagaatgcttgtgattttcgcacattgattttttatcctgagactttgctgaagttgcttatcagcttgaggagattttggctgagacgatggggttttctagatatacaatcatgtcatctgcaaacagggacaatttgacttcctcttttcctaattgaatactatttatttccttctcctgcctgattgccgtggccagaacttccaacactatgttgaataggagtggtgagagagggcatccctgtcttgtgccagttttcaaagggaatgcttccaggttttgcccattcagtatgatattggctgtggttttgttatagatagctcttattattttgagatacatcccatcaatacctaatttattgagagtttttagcatgaaggttgttgaattttgtcaaaggccttttctgcatccgttgagattatcatatggtttttgtcgttggttctgtttatatgctggattatgtttattgatttgcgtatgttgaacaagccttgcatcccagggatgaagcccacttgatcatggtggataagccttttggtgtgctactggattcagtttgccagtattttattgaagatttttgcatcgatgttcgtcagggatattggtctaaaattctcttttttttgttgtgtctctgccaggctttggtatcaggatgattctggcctcataaaatgagttggggagaattccctctttttctattgaatggaatagtttcagaaggaatggtaccagctcctctttgtacctctggtagaattcggctgtgaatccatctggtcctggactttttttggttggtaagctattaattattgcctcaattttagagcctgttattgctttattcagagattcaacttcttcatggtttagtcttgagaggatgtatgtgtcgaggaatttatccatttcttctagattttctagtttatttgcatagaggtgtttatagtattctctgatggtagtttgtatttctgtgggattggtggtgatatccccttttaattttttattgtgtctatttgattcttctctcttttcttctttattaatcttgctagtggtctatcaattttgttgatcttttcaaaaaaccagctcctggattcattgatttttttggagggttttttgtgtctctatttccttcagttctgctctgatcttagttgtttcttgccttctgctagcttttgaatctgtttgctcttgcttctatagttcttttaattgtgatgttagggtgtcaattttagatctttgctcctttctcttgtgggcatttagtgctataaatttccctctacacactgctttgaatgtgtcccagagattctggtatgttgtgtctttgttgtctttggtttcaaagaacatctttatttctgccttcattttgttatgtacccagtagtcattcaggagtgggtagttcagtttccatgtaggtgagcggttttgagtgagtttcttaatcttgagttctagtttgcactgtggtctgagagacagtttgttataatttctgttcttttacatttgctgaggagtgctttacttccaactatgtggtcaattttggaataagtgcagtgtggttctgagaagaatgtatattctgttgatttggggtggagagttctgtagatgtctattaggtccgcttggtgcagagctgacttcaattcctggatatccttgttaactttctgtctcgttgatctgtctaatgttgacagtggggtgttaaagtgtcctattattattgtgtgggagtctaagtctccttgtaggtttctaaggacttgctttatgaatcttggtgctcctgtattgggtgcatacagatttaggatagttagctcttcttgttgaattgatcccttaccattatgtaatggccttctttgtctcttttgattttgttggtttaaagtctgttttatcagagactaggattgcaacccctgcctttttttgttttccatttgcttggtagatcttcctccatccctttattttgagcctatgtgtgtttctgcacatgagatgggattcctgaatacagcacactgatgggtcttgactctttatccaatttgccagtctgtgtcttttaattggagcatttagcccatttacatttaaggttaatatgttatgtgtgaatttgatcctgtcattatgatgttagctggttattttgctcattagttgatgaagtttcttcctagccttgatggtctttacaatttggcatgtttttgcagtggctggtagtggttgttcctttccatgtttagtgctttcttcaggaactcttttagggcaggcctggtggtgacaaaatctcttagcatttgcttttctgtaaagtattttatttctccttcacttatgaagcttagtttggctggatatgaaattctgggttgaaaattcttttctttaagaatgttgaatattggcccccactctcttctggcttgtagagtttctaccgagagatcagctgttagtctgatgggcttccctttgtgggtaacccgacctttctctctggctgcccttaacattttttccttcatttcaactttggcaaatccgacaattatgtgtcttggagttgctcttcttgaggagtatctttgtggcattctctgtatttcctgaatttgaatgttggcctgccttgctagattggggaagttctcctggataatatcctgcagagtgttttccaacttggttccattctgcccgtcactttcaggtactccaatcagaagtagatttggtcttttcacatagtcccatatttcttggaggctttgtttgtttctttttattctttttcctctaaacttcttgcttcttttcattcatttgatcttccatcactgataccctttcttccagttgatcgaatcggctactgaggcttgtgcattcgtcatgtagttctcgtgccttggttttcagctccgtcaggtcctttaaagacttctctgcgttggttattctagttagccatttgtctaattttttttcaaggtttttaacttctttgccatgggttcgaacttcctcctttagcttggagtagtttgatcatctgaagacttcttctctcaactcgtcaaagtcattctccatccagctttgttccattgctggtgaggagctgcattcctttggaggaggagaggcactctgatttttagagtttccagtttttctgctctgttttttcccatctttgtggttttatctacctttggtgtttgatgatggtgacgtacagatggggttttggtgtggatgtcctttctgtttgttagttttccttctaacagtcaggaccctcagctgcaggtctgttggagtttgctggaggtccactccagacgctgtttgcctgggtatcagcagcggaggctgcagaacggcgaatgttgctgaacagcaaatgttcctgcctgattgttcctctggaagcttcgtctcagaggggtacccagccgtgtgaggtgtcagtctgcccctactggggggtgcctcacagttaggctactcgggggtcagggacccacctgaggaggcagtctgtccattctcagatctcaaactggtttcaaagaacatctttatttctgccttcattttgttatgtacccagtagtcattcaggagtgggtagttcagtttccatgtaggtgagcggttttgagtgagtttcttaatcttgagttctagtttgcactgtggtctgagagacagtttgttataatttctgttcttttacatttgctgaggagtgctttacttccaactatgtggtcaattttggaataagtgcagtgtggttctgagaagaatgtatattctgttgttttggggtggagagttctgtagatgtctattaggtccgcttggtgcagagctgacttcaattcctggatatccttgttaactttctgtctcgttgatctgtctaatgttgacagtggggtgttaaagtgtcctattattattgtgtgggagtctaagtctccttgtaggtttctaaggacttgctttatgaatcttggtgctcctgtattgggtgcatacagatttaggatagttagctcttcttgttgaattgatcccttaccattatgtaatggccttctttgtctcttttgattttgttggtttaaagtctgttttatcagagactaggattgcaacccctgcctttttttgttttccatttgcttggtagatcttcctccatccctttattttgagcctatgtgtgtttctgcacatggtgatgggaggtactggtattacaaaaagcttctcccccgtgggtcaaatctaagctgagtgttgagacataattgaaattcactagatagataggagataggggtagggaattctaatcagagggaatagcacatgtaaggcaaacaatacagtgcatctgggaaagctatacaattttattgttataggacaaatgttggggaatgttgagagatggaactggagagtgaggcagaagttagcatttattcatttattcagcagacctttatctattacctacattgcactaagtactgtgtgagcattagagagaaaaagatgaatgagattggacaccattcgttcattcctgactatgaacttggcattgttctaggtaccagagatataataatgagaaacagacatgctccctcccctcattgaggttacagcttagtgtggagacacacagatgcctaacgcactatggtatggaaggtgctatggacacagtgctcaaatccatgatctacataggtatgagagtgacttttctacaacttaaatctgatcttgttattccctgcttaaaatcctgcagtagctcccagtagtgccttctggttaaaatacaagatatatagtatgacctctcaaggacctttgttatttgtctctggccacctctccaatttttcaccatgaccctggccctgtcccactggcattccatctccaatcacacggaactatgtggagttattaaaatgccctatgttatttcaagactcagagatttagtgcctcagcctgttttgttccctctcccctcctccacctggccttctccagctcactcatcaatctattagactcaggcatcatctgcttgccttcgtaaccctccccaccccgctcaccttgctggattctgtgcctttgcttgctggttcccagagatccctgcccttatttttctttgcctgctggatttgcagtgttgtgtcctatatggtgtagaaaaccagctcaggctcccacttctctgggcttatgtggtcagatgcagacctgtcttccatccataccaaaggccatcagggagtttcttttgtcctcttcaccagcccattcttaatctttctgataaattttctgcactgtgtgcgcgtgacaaattgggtcaaggtgatggtaatttacagcatgagatggtgaacttgctgcctgtgctgatgagcccattggatttcccctaactagtctgtttccctacccaggtggagaacttcagtagaggaagtggcaggaatttgggaatgaggagcacagtgattaaactggggccattcatatgagagtttaagaactcagaccagtgacttaggtgagtaaaaatatcagaaaaagggaaagaggataagagcaacttgggccataattaaacttgtcaatgaaatgaaggtctgttattctaatgcctacattttgccaaacctttgtgcttataacttcatcatttgctgtgattaacaaagttgaaagaataataactacttacaaggcccacatcacctccttataccactagcttttgctttccgtacagacatagctttaaaaagtgcaaatcctattctgtacctgagccacaaccctaaaagggaacttgtttacaattctaagaataatattgtcctttaaaggtgaaggctcgctggaaaacatgccattcatgtgataaaaagcaggtagcaggtagtgctaaagacttactagactgcatgtttgtgctttctgctgcattcctctaatctcaaggcagtataaggagataacatcttcacagccctttcagccctgttgcaatttctttgaccctggcctgatataaaaggcaaacttggtttttcactgttctagtcatgcagtttctttgtggttccctttagaaagacttgaggctatgagtcaaagcttttacgtcttgctgatagttcagagttgtgatgtgaagcaataaataaaatccctccttccacatacttgtctccttgattagaatcattctgggcaaatttagaggctcataaagtccatttagatatttagtgaaaaaacaccagcactcagaacagaatgttgataatgtagatggaatatctttctctctctgtctctgtgtgtgtgtgtgtgtgtgtgtgtgtgtatttatatatgtgtgtatttatattatatatgtgtatatttatatatgtgtgtgtatacatttatatgtgtatatgtatttatagtaaatatatcacatgtatttatatatagtaaaaaagaggggactataatatatctttatatgttagcatttattttaaaaagaaaacacaggaatatctaaaagaaactattacttataggggttatgggaaatgccatgggcaagaattttttttttttttatcaccatgctttctgaaacaacacgatatgtatcacctttataaaaataaaataaaataaaaaatgaaaaacaaagtccacttgtaaccacatgtcagtagcatgtttgctttcagggtacatcaaatgcattctatagcacaggatgttccagtcactctaacaaaagatgtcctgtttggaacaccaactctgtatcagttacttcagacactttctctcattgagtcccttcagcaagcccttttaggtttatgttcttagatgaggaaaccaagtcttagaaacattaactggccaaactaagatcagagagttagaaatgtcagagcccagaactggcatcttctgacttcagatcccatgtactttcccctacactgtgctgaccacacctccattactacagatgtgttgattacatctaggggccaaagtacacattcatccaataaatgcttactgaatgcttaccgtgttcagggcactgtggcaatcttttgtaatgcaagaaaaataagagtagtgaagacagtcaaggaaacaaagaagcctaatactaggcaagaagtgcttttgatggaattaagcacaatgagggtgttagtacagaaaggacatttaattgaactgggaaagttcatggcagttttcccagagatgagtcttgaaggacaaatggtatttagccaggaggaaagggggtcaagtgtattccagggagagggaacaacatgtacaaaagcacagttttgaaagaacactccatttttgaggaatagccaatagctgggcacgtctagagcatagggtagtagagagaaaggaggccggaaatgggaagagacttgaatgccacattcagttatgtggacttcatcttgtagcaatgggagcctacaaaattttaagtagaggaataaaaagattccatctaaaacttagaaaaattactttggcaggataagagacaatgaattgacggggagctgggtttgatagcaagaaactgtttgggagactgttctaattacatattttcttgtttttagatgcacatatacgtacttttttagctggtcatttctttctgaaattggaatgaatcttacaatcaatggcatgttataatttcattggcagcattatttgtctcttaagggcccccaaataatagtgtgtcacataactgatagcatctcaaattagatgaaatacagtagtccaggcaagaaatactgagatggtggggtggtaaagagggaaaagatttgagccacatttagatcctgatgtggtattaattattaagtaaaaaaaaggaatgtgcagtacatattcagtatgccacaagttgtggaaaaaaggtgtgcatggatagatgcacatgtatgtattcataaagttaatgtggatgcataaagcgtctctagaatgatacacaagaaacaaataacacccgtggcttttagtggggggcattgggtggctgagggagaacagcggtaggaaaatttttcattgtgttctattttgtacatttgatagtttgaactagtcgtattatgcacttcaaatatgtaaaaagataaaaagtaagagatatttagaaaggagcattgacacatttgttgacagattggttatgggataaaggcgatagtattttattgactatattttattcttttaattattcctctaatttcttaaaacaactttattgaggtataacttccacggtataatttcacccattttaagtgcatgaattcagtgatttttagtagagtcattgagtagtgtaaccattcctacaatggttatagcacatttttatcatcctaatgagatccttcatgctcatttatttaatctccattcccatctccatccccaggcaaccataatcttccatgtttttaaaatagctttgcctatttttggatgtttcatacaaatggaatcatacaaaaggtggtgttctgtgtctagcttctttcccttaggataatgttttctggtttataaatgttgcaaatgtcagtatgatacttcattcctttttatttgtgtctacaaaatactctattttatgtatataccaccttttgtttttctgttcatcagttgaagaacattgcagccgtttttgctttttgacttttatgaataatgctgttataaacgtttatgtttaagtctttgtgtggaagtattttttcatttccttgggtagacacctagaagtaggatgttgtatggaaaattaatgtttgactttttaagaaactgttttccaaagtggctgtaacagtttacacttctactaacaatgtatggaggttcccacttctccacatctttgcttacacttattattgcctgtctttttggcagacttaagcctagtggttgtgaagtggtacttcattgtgggtttgacttccattcccctaatgaccaatgatttcggacatctttcaagtgcttattaaccattcacgtgtcttctgtgatgaaatgtctatttgaatattttgcccaatttaaaactgggttgtttacctccctattcttgacttgttaggattctttgtatttttaactttaatttgactgaggataatgatccaccagtaaagagatgcatttatttctgtatttatgaaaatctttaaaattcctctacctttcagagacacccttcaacagactgcgcttcttattttcagagtatgtatttccatgataacacaagtatcaattataaatattaattacaactttccctcctcactgcagactcaaccaagagttataaatctgtgtattactttcaatgctcataacaatcttcttaaccaccataagcagactgaaaaagtcaatctagttgaattgttttactttataatgcttttataagatactcagtctgaaactgaaagataggtagctctagaaatgtgataaatggccacagaagtaacaacttttaataaattaaattatggatgttatgtcaattttaagtaatgtctcagttttatatcttgttacctgacctaaatatcattccctttagtaaaatatctattaaagctttgtggcaaaataagaacagaaaaatggtttttgattttcagctttctctggtgaataatttgttttcttttatttttccttctaaaataatcacacgtttcattgcaaccctaaccctcttcaacacacacacacacacacacacacacacacacacacatggcttctagattctacatgtacaagagtgcaaatcaaactaccatagaaaaactaagaagagaggcctagaagcaagaggctgatacactatctcaggcttcaacaaaatatttatctctgactataccaaggatgggcagagcttgcatgtaagtggcttgggctagcagactgggttttgaaggaggacaacatggccatgttcttggttcggtcatgaactgtctatggcacataccttaaatactgttggaaggatccgttagctccagagactgcaaccaactgcctatggtcataactcagctctcagacacattttgttgtgcccacagagtgctgtttgcctgtttggtttttaaaccaacacttaaaatgcagggaatttaagataaaaatttgataaaaatgggaagatttggccgtattgggctcatggtaactgagatgcatctgaatgacaggcattcctttgaattgcacatttgctcttgtttttactataggccactctcactttctgtttttttccccggctttgaaacgatcagttttagtactgaaaaattatctaggatactaaaaccagaatttctctgctagatggcttgctcattacattacctacatgattctgtgtaagggattgtgtaagttttctatggttgccataactatcacaaacttgatggctttataacaacagaaatgtatttacagtttggaggcagaaggtctaaaatcaagacttctgattttagtctgtccaagagcctctgctggtagggccatgctctcggcagaggctcttggggagaatctgttccttgcctcttccaccttctggtggcttcaggtgttttgtggcttgtggctgtatcactccaatttctgcctctgttttcgtatggccttctactctgctcctttagtctctcctttaggctgtttcttataagacactcacctaaaacccaaaaacaatctaaaagattttgcaaatatgaacattctaattaccttagagttaagattttcttttctgctaagtgagggcatggtgcagagagcaggaaagatgtgaaactagatagcatacaaaaataggtgttcatagatctgggcctaacaagggtgtggccagcaactctgccctgctttatcagcattagaaagccagtcctctcagaaagtgcccagttagctaaattcatgagattatagactattaaggtggaatggacctcagagatggtccttgctctcatctgaggcttcagttgggccagtcagaaatgtgggaaaattgaggcaggtcaaataaccaggagtacaaacaaacacaatctatccagaaaactagaaatcttactagtgactattcacaggttactttctgcattctggggttttcattctagaacagatgtgtgtgtgtgtgtgtgtgtgtgtgtgtgtgtgtgtgtgtgtgtgtggtgcgtgaagagaggggaggggtgcccagaaaaccatacccactttcccacatatcccaactatgactgggcaattatgtcattatcaccactgatatatagctggaagagtttagtgttgccctgctaagatctggattttcttttctggagcttggctattggggcattgagaagtccagccaggaggttggtcagaggctaacccaaaaagctttgcttaactctgggctacagctgggggttgccagagagaagtgcctggcattcctgcatgctgacatcaagcttcgaagttgctgccctctggtgagtcagcagcaaaggcccacatcgttcgagaatgctgcccaatcagaagatgtgatgccacacctcagaaatctttctaaacctcagcattctgtagacttcaaacaactcctcctgagaaagaatgtagaaataattaaatttataagattaaagttataaaaagcatagagcctataataataacagcaataagataaactccacatttgcttttaaaacaatttatttgagtagacagccaaccccctgtattgtactcctttaaaaaatattttaggctttttaaatgctgaggcaaggggacataccaaacactaacaggcacattggggttttctggctattgaaataaaaatgtccttacataacactgatgtactggaatagcactgcgttccagtgacggttattgcaactcagccagcatatctgtagcttgtgagcttttcttatcagaattttatctataaatatacatatacgtaaattctattgtgaaataaaaataaaatgtagaatcttctcatctttcttattagtcaatattgtgctactctttaataatttctctcaattttttcattaagcagatattactagggaaatatacatgaggcagaaggcaaattatttgcttagtgcaatgcaaacttgcttaacaggtaagagcagagtcccttccatagcattgccaccatatggcattgccatatcgtggaggccataaagaggaatgacattgtaaagattaactggattttacttggcaaggtcaggcacctagatggcatgctataaaatggttagaagtgcaaaggaaacctgtagctagaggccatgtgagattatggaagtgacttttcttacaatcctgccatctggtttggattgtcaggatcaaaacatttcacttgcccaagtgaggatgctctctacatggttttggggatgagggagactcagaaataatgtttgtggtactgtagcaccactaggaaaagagaaaaattggacctgacatgaagaaaagcatgcagccagccactaagactacttcccacaggactggaaatctctaccaccgtacctctcctacatgctgggtataagaagttaaagggaagccagattatatttacctactctttcattcattcattcactcattcatttattcatccatttaccatttgtttgttttttgttcatttacttatttaataaaaattgtgttttgcatattctaggtgccaggcattgaagaaccactgttattgttctcaaatgactgacagtttagaggagaaaatggaagaataaatagacacttgtgatgcaatataatagtgctctaataagagcaacatatattgaataccactgaatattaaataccagggactttgctaggagctataaattaatctccacagtacatctaagatagaagttttataattactctctttaggaggaaataggggtctatagaggttaagtctcacagcctggaaggagtcaacaaaaaaatactcagccttaggtattctgactagaagcttgggtccttaaccacctactcaccaatttgaagaaagatgattgaaactgcaacagctacactgactcttgaaagcaaagtaactcgttaaatgagggtatgtgtatactggctgggatattgtgggctcatgatgacttgtaggccgaggcagctgcacatatgaagactatggagggtatatcatcagcggaaatgaaagtgattagtgttggaggtttcagtgcatattctggttttctattactgcataacaaatcaccctaaaatttagtgacttaaataaacatgatcatttatttagctcatgaatttgcaagttgtgcagcacttgggtgggatagctcacctttcttccatgcagtgtctgctgggactgcatgattgcatgaagcggggctgggcagctagagctcttcatgaatctctatttttgcatgatattttcacaaggtctctcaagcatgggagcttcaggtagcagaacttctgacagggcagcttagtcctttgaaagtgtatgtctgaaaagagagactcaggcagatgctatattgccttttgtgaccaagccttggaaatcactagtctctcttgtgttgaggtggttataagagcctgtccaggttcagtagggagcataaatttcacctctgaatggagaagtgccaatgtcctgaaaaagcatgtgggcccagaaatactgttgtggcaattttttgaaaatcaagtgtgataaagacagcatagtgtagtcataaaaaacagattaggagcatgatgtgctttgatttcaactatgggctttattacttactaactgggttactttggttaagttgtttgactcttgttttttgagatggagtcagtctgggagactccagctctgtcgcccaggccggagtgcaatggcacgatcttggctcactgcaacctctgcctcccggatacaagcgattctcatgccttagcctcccgagtagctgggattacaggcacctgccaccacatctggataatttttgtactttttttctttttcgagaccgtgtctcactctgtcacccaggctggagtgcagtggcatgaactcggctcactgcaacttccacctcctgggttcaagccattctcctgcctcagcctcctgagtagctgggagtacaggcacacgccaccatgccaggttaatttttgtattcttagtaaagatagggtttcagcatgttggccaggttggtctcaaactcttgacctcatgatccgcccgcctcagcctctcaaagtgctgggattacaggcatgagccactgtgcccggcctaatttttgtatttttagtagagacaggattacaccatgttgaccaggctggtctggaactcctgacctcaggtgatctgcccaccttggcttcccaaagtgctcggattataggcatgcgctaccgtgcccagcccaagttgtctgactcttaattctcagctttcttatttgtaaaatgaaggtactagtactaatttggagagttgttaaagattaaataatatatgtaaatgccttggcataagggactggcacaaagtaggcacttcatatataaaagctgtgattattgatgaaccagtagtgaggtacataactggggaaggagaaggggccagtttgtgggaatgcttttttagttattaatagtaaggtggtaaaataataatagtaataataaccaaaagttactgaaaactaaatacagtgctaaactctttaaaaggagtatctaattggatcttaacaacaaagctatgaagcaggactaatgttatctcattttataaatgaggaaatgtaagatcaaacaggttaagaaactttcccaagttgatcagtagcaaagacaggattcgaaccaaggtaattgtcctatcagaaactgtactaggatagtctgcatttcatggtaaagactatcagatgccactaaaactttttaaaaagggaagtcttgtggtcaaatttgctctttagaaggcagtatggagtgcagatcagatgctggcagcagggagatcagttagaagatggttgctctaattcagttgagaaatactgagacatctgaaatattgaagacatcagtagtgtgggtgatgtgaaagtggttctaagaaactagcggcaatcatccttcattactgattgggcgtggagagaaagagaggtagcattggtagccgttagtcaactctgagtgcaggcactggcatgtgcattattacccagggctctaagtggagaaagaaaacaaccccagggtgtcttcaaacctaaagcatatttcctaagcctttgcactctcagtctagactaaaaacaaacaaagcagcctcctctgaaatgctggaaactttccccacttgaaactctcagatctcttaccttgcaattctagctttcaaattccaagctgagcttcctttcccacaccccgagtccttgtactggggattacaatgatcatttgtatgtactaggtgattgttccttccacatcaggggccttggagcggatgacctaaagctgctttctcctgtcctgactttctccacccagcactgcaaccatacatacaattttctggtcttgtagagaatgactgactggtcattatagtcttccaaaaggataagagattagtgtcatgatgtggccttcaggcagccagggggaatctccatatgaggtacttgttgactgtattacttagttttaggtgaacttcctgtggagggacaatatgtgcttagaaggacagagaaggaatgtattaggtaaggcattctacatctcagataaagaacttcaatgaattgttgggtcaaggtctaagaaacaaaccagccgtcaatgggaaagttaactaaaatgaagaacccaacatacaaccccaaatcctagtttttctgactatgttttcttaaactgaaataatttctgagattaaaaagaagttgctgtgactttgtctgatagatgtatttttttgttatatattagtttgggccttctatctctcctactttgttttctttataatagaattaatctctgaaaagtaactttactgtattctgatgctccattttgaataagtcagttcttctccgaatgggctctggagattggcatttgattgaacagcttttgtgtattgattgttttaggtagactgggtactccatttaacttagtatttctgacaataaatcagtcgagaagggagtattactctaacggtttgaacacttgtctatgcacattgcttggtcattcaataagtagttattggtgagatcgggcacgttcagggtggtatggccatagacaataaatggttacgactctgccttcagctgtaccagtatttaagttataaggtagttaagttacaccagtgcaaaatcatacagtttggtcacagtcctacttgaggatctcaaacctagctccccttaacaaacatggaggcttaatcttggctttgcacactgaattattcctttagaaaaatacttggtgtacaactcatccttttcatttacaaagaaacaaatttgagcagtttcacaatttaaaaagtctcccaaatggattatatttaattgtccatttccaatgaaactcactaaattggtaaatagcagtgagtgaataactgatgaggtcatactttcttgttttggactactacaaacaccacggagcaacaacagattagaatataaaggttaagcaagggtttagtttttgttcaaaagccgttttgcttgttacaaaggctaccaaacctttgaacatcagaccaaaccaaaaacaaaacaaaacaaaataaaaaaaaccccaaaactgaaagatgaaaacatagtttgataatctaagctgctcttcctttatttaaccttgaatttatgagattatttttttccccagaagaaaaattctcttagggacactttcagcaatttaacattttctaagcattacagcaaataagaggcgatcatcattcttcagtcataaagataagccaaggaatgaaagtgttttgcaggtcatgtcacctgacagaaactttggactggtcctttcctggttcaagagttcagccataatacctactttccctatcagctggctcaagctgataaggtcctgaagcaagcaaagcttctttatgagcttttatttaattgtccttgccacataagggttgaggggattcgtctgtacagagttacttcttgttggtctattttttctttggaataaatcgctgtctcccctgactggatagagtaaatagagtttgtttaaacacttttcatcaaattcctagtgcctagtacagagcttttaaccctaatacgtttcctgcgtgtacttattgaaggaataatgacaaactctgccttagattggtgactggctagggagaaacatggttcaagagctgaataagtaagagcaagtattttattgtatgcccatcaaatgtattcgatgctggtgatggaggtaagagtgtgatagaggctgagttctctgaaattacatatgagatgtcatctgccatttagtattagctgtgtctgtcttttttccaggaatttggccttaaaagagatcattcaaaagtattacccaaatagtgatttatcaggctttattgtggggaacctaaagtggattgcaactgctatggtccctttgaagggagctggtgcaagattttccatgcctaatcacactcattttcccttgctctcccaatgacctcccatctttccttctatttggtctgataaacaccaacaataggatcctttctgcagcttccatcctaacttgtattctagccttaacactgcaacaaactcactgttacctagaagtcaattgacttccctgaatgttagcttctttagctgtaaataagtaattgtatgaggtgatggttaaggtgatttactaattttacaattctattattttatgaatagaccctagttaggatagtttgaaatagatacttaatccactattattctctcttctaagatatagttactagttgatcatacttttccttaaaggctgaactgaattctctgatatcagcaactaaacatctcatatttgtcagtatgaacatccactgggtgcctgttatttaaccaggtagaattcttagctgtgattgaaaatctaggtatctcttctggtactatcacttggatgagtaaagtttgaaaaccattaagttgacatttctaataggactgtggatttaacatagattcccagaagtcttggaatacaacagtgtacacagatgaagatacagtactttttggtattttctttttgcaagtgttacaaatatctgcatgtcataacatcatcactatggatcccatcttttaatgagagcttagtatatgctacacactgtcactaaacatgtaggatcttgtttagttttctcaaaatgttgtagttactatgattattttttgtgtcttgcaatcattgtgtataagtgcgtaaaccatgtatctagagtttatagaagaattaaaattcaaaaaccctatactcatctctcatttttaaaaaataccattttacctgtctttagatgccctgtatttcctccccaatctcatcccgctcctactcttgaaagtgatcactatccaaattttgtgccaaacattaacttgttttctttagctttgccatctatgtatgtatccctaggtaatacatggcttagttacacttgtttttaaatttgatgtaaatgtaatcctatagtatgaattttctaagacttgattaatctatgaacattttattttgagattcatcaatattgatgtgtgtagctatagtttattcattgctgttgctgaaaaatattctattggatgactttgctacaatttattctaccattgttggatatttgagttgttcccattttatttatttattttatttttttgctgttatgaacaatgtggctttgaacattcttatactacctggcgtgtatatgtatgtatctgtctgtctgttcatcttaagatgcactacaaaactgaggcctagagtcaccaagcaacttgtttaatgtcagagtgagttggtggtgaggccaaagtctgaattcagcagtctgttaccatagttttcatccttaaccacaatactctatgaatccttattttaaaaaggaaggtctggagaatttaaaataacttcctaaagagcagggattcaacaaagctcagtctgactaatgccttccatttttaaaaaatcacccaaagcacatattatgattctatttgtgaagtattagctaattacaagagaatgagttcatacttggcactactatctctttcttacaagtgatcagatgtcaaaatgtgaaaactatacatttcacattatccatatatatgtgacatttttcctttaggaatatgagtagaaatagaaagacaggtttttacagtgaaatagattttttttctctctctttagcctaccaaatctctttcgcaatacctaacacttataaatgcatttaatttcagtgccaattaaagaaattcgaaagtagataataagtgagacaagcacccagtaaatgtttatgatgtgacactgacaaattatgggctgctataatcaagatagcattaaaaattttaaagtgtttgtatgaacaaaccattttggaaggagtgtttggtgtggcagtgagcaaaacaacccagtaactatggcagttagtgttaaagctctgattttgacatgaaaggaataaaaatggaagtccagctaaatcacaagtgtcctggagaaacttggatgagtttcttggctagaggtttttcccaccacagtaagtattttcaaaggaaaacaaagtaaaatttttctcttgtatgagtcacatctctgttggttgtaagtggctgaaactcatcttgaactaccaaggtaagagaagaaacatactggttaatggaattccagaaaggactgaacaatcaaaccattttgaaggacagcatagagctggactctagaacagccaaaacaaggggttaaaccactgcgagggatctctctccaactcttgctcaggcttttctccctggcttgactttcttctctttcactgtagattggcttctctcacatggcaagaaacattgctgctagcacttcccgagttctacgttctacaacatccaccactggtgagagattaacttatggtttttctgttgaaaagtcaaaaattacctgggaaaagtctgattgtctcagattggagatgttgcccatctctggaccaatacactattatgtgtggctgactatataaaaacatggatattttcttggaatcacttggtttgactgggagaagaccattctcaaaacaaaggaagtgcaatttatagaaggtagtagaataggcagataaaacaataattcttcactatattgctcaaataatccccatgacatttttagtatattataaagagagttctaaagtgtttccaaactattatagcaaaatttaatcttataataatttcttcttgaactatgtataatttacctgaaatattttccaaaaagcaatcaatgtgagaaaatgagagccctgtcttcttaaaaaaatgagtaaaagtccacaagttcagaacaaaagaaaatgaggtaaggcctaaaataaattgtgctaagaaagctaaaattctagacaaagtcacatcggcaaaactagaaggttggtactgtgcttcagtttactgcttgctgtttggttaagaggaggggtgatgtgataaaaatagtgacgaagtgagaaaactgacgtattagttttctattgcattataacaagtcaccacaaacttagaggtttgaaataacgcccatgtattatctcgcagttcctgtgtgtcagacctccaggcactgcgtggctcggctgggttctctgcttagaatctcacaggtcaaaatcaaagtatcaatgggagctgcagttctcccaagctggagcctgtgtcccttttaaactctcaggctgctggcataatttatttccttatcaagccatccatatgatcccctccatcttcaggccagcaatggcctgtcaaatccttctcattctttgaaaatctctgacttccctttctgtcacagctctgtaacttcttttctcttctgccaccagcagaagaggcttttaagagtttatgggattagattacatccgtctggataatcttttacttaaaggtcaactatgctatataacatagccaatcacattcgcacattgcagagactagggtataaaatcttcggggtcattcctagaaattctgcctgctgcagcctggtttcttgcttggactctagtatatatttgctaaatctcccaagcctcagtctcactatttgcaaaagtgagttttaatgctctttgccctgcttgcctcacaggatcttaacatagacgtaagatcaaatgcaatagcatgtcaaacaatgtgtaactccagttatacaaacattactgtatctcattggggatacgaagctctacacacttgaagatggtgaaggaatataaaaatgtaagtattgcttttataataaatgtgttcctattggctgaaaatttcaatatctgatacaaatagtcaactttctattttactttttctaattatgcaagaccttgtaatcacaaatgtaaaaattgcaagccacatgcccctaaggccaaataaaaatttgtaaaattctcttaaaaagactctatagagtccaaatgaaaatacgtcgagtccttttaaaaggatccaaccacatatatcaactgatatacatggtaccaaaaacaatggaatcttttcagattctctaattggcctttggaacttatgtagcatcaggtatgcaaatgaacaacttcagaccttgattactccaacctcctctcccactgtcacagccacttctgtcatgacctagttgttctcagaaagttccctcttatacctggtcaaacttctcttacaatcacctgtgactttccctcttggtcttggatcaaatcatcctaaatacattaaaagtcctgattcttcctgtcccttaaatatatctctacttgaatcactgtgttagttcaggtcctctgagagaaagatgttaagatgaaattagatgtgcaagagattcgccgaggtaaaccttgtgggagaaaatggagaggtacatagaggagcctgggcagactgtgtggctactatgtaagactcatccccatgaaggagaaaggagaggaaggcaaagaagaaaaaccttaagatttcaattctaagaacgttttgacaaagctgattaggagtatttaaggcaaagctgcccaccagaagagtactgcatctttcaggaacggacttgctttagtacatctgctgtgcttagtaattggctgggagcagccatagaaagcatggactcagtacaaacttggtgatgaatttcagaggcagcggctaagaccatcagtctattattttccttgcaatagctgtcataattactatcagagcaaacaattttttgtgtgtgaattcatgagataatggtcttttctttcctgctttcaagagccatgtcattgaaagagctaatcattcaaatttatgctgcattactgactaaatactttcatttatcatactttattttaaaatactttaactcatggcccgatgattttcagttaaccaaattctcccttactatcctggttgccccttctgtcttttccttagaaatgttattgtagtatttgcaagatggcctgaatcctgaaccccccatcttcaatgagcaccaaatggtaattatagattcccagctgtagagctatgtcagacaaaggaaacttcattagtatgtaccaatgtttggactccaaatgcttttgtgtctgagtcacaaggactcctcttccttggtggcttaaagttaggctgaagaagatttacattatgttgtgcatgacctctttagtttggttctacttatactttcaaggagggaagactggggaaggtgtcccttagtgagcatattttgtacaaatgaaaacagggtactaacacttatgccaggacgcatgcataaactaggatggttctgagaaaactgcgatatatgatcactccagggtctcccctctcagaagcgagggagacttaaaccttttacatcaccaagtacatggaaagaaagacagcagggaagtgattccgaagagaaacctgaaaaaagcaatgtggaaagatagacactttagccttttctttcttctcaaaacttcacattccttttcactctgcttcacttaagctgccctagttccagagtgtttcctctcttgggtgaagatgggaacaagtacatggggtagcaaggggtgggtgggacctgtgctcccattaaggttcttccagaatcatttctatgtgattatcagcttggatcacatggacttggggattattggtggttttctagggtaaacagggcatattgtgctggaggacatattttatatgtaacaatttggggaaattttcttttatattaaataaaactgagatatgtaatgaattaggatgaaaaattcatattcatctgaattttataagtgaatcatgagaactcaaagatacttagcccttgggaccattttttactcctgttcggatcccttcagctaagcatgattatttactattttcagctattagttatgtcttgttgaaaaagtatgaaaagagctgcccaataaattagagtgtatgctcaacattctcttagcttctttatctctttccaaaattggatcaaatgacattggacatgatcaacttcttactgttttgacaaacatctgaggatacttttataattgataatttggactagattatgcaatgtgtgatgagacacaaggtagtctgtactccccatgatatgtatatctgtttgatatactcaaacggtgtatatcaaacggatataagtttgagtaggtatggagatgagccagggtttatttcttcaactagtatttactgaatggtcttatgtgccacaactgttctggaaactgtgatacattaattaacagataaagcctttccctcacaatgcataacagacccaacagagtatgaatgtacatacaaactagtaaataagaaaacaaataaaagtattcagatagtgctataactactgggatgaaaatcgagcaggaaggaaaatatagcctgcttgatgtggaagacagggatagcctctctgaggaggtgacatttgacccaagacctaaatgaggagaaggagacagtgagatgaaaatgagggaaacagcaatggcaaatacagagaacttgagacaacttggcccattggagggacagagacaaagccaatgtgggaccacaggggatgaaagggaggctgattggagaaataggcagtgctgaggccataaaaggtcctataggtcatggaaagacatttggttaccattctaatgacagtgagatgttactggggagttttaaactggagaatgtcataactgtccagatgtaaccaaatagtaaaaccattcttcctgaataacttggctaaaaggaatattatgactacagatgtacatgaagattaagcagaacatggaagaaaggcctcaagtaaacttgacctcacataaatatgggaggaagatcaaatggaagctgggagtgttgaaagaatgtaaggggaatgacttctaataatgaacaaaaagctgttattttattatgaagaaaaatgttatgcatcttatgcatgcagaagaaattcccattcaaaagacttggaaaatgtcttgggtgtttactataataaaccttttaagatatagaaaattcacatatttagagcttaatttctaaagagctcagacttctcagtttattatatgctatgaaattttgtttatttttaatttaacctacttgtgtgcaaaatcaataaggaagcttaaggaatataaacaactatttaacatggccatttaaatagattcaaagtaaagaatatcagcatagtgtttctttgatatgacaacccctcctcccagggcacttaaatgaagggttgggggggaatcttaacctgaaattgaaaaccctgaaatcatgtttccaaggaaggagaaggaaaataggaaaaacaaaaacaaaaagcagcaactcatttggaagctcgtgggagaggagaggaggattcatacatctcggactggtttgccttagcaagtgaatcatttaaataggaaaaaacagggggctgactcagcttgagcaaactcttgctatcccctgctgaggtccgcacttgctgtggcccctgccgctctcctcggaccttgctgccctcctcctttgtcactgtggagaaacaggaaggaatgtttattagcaagactgactggggtcacacccaaggcaatatcaggtttttacctctcccaggcctgggaagaggttcaaggatcaaggacaagctcccggttagagtgagaggcaagttcaaacctttgaaaaataaactcacaaccagcatttggcacaggcctctggagtttacagaatgtatctgcctgtgtgtgatttcattagttcctcctgccaatctaatgagattttacgtcctgtaacagtgaggcaattggagtctcagcagggaaaggaacttgcctaaaactgcaggatgggtagcgcttggatcctgactttctgactcctaggactgtgctgtcttcagatgatcacatgccttcttggcagatgtttctaacaaaggagagagttgcccagggtggggctctgctagctcccttgtcatgagccattctctccacattgccttttagttgcaccacatagtcaccttcaattagctgtgcgaataggctcactcttatgctaacatgtactaaaagtgaaaatggggagagagagagagagagagaaagagagacacacagagagagagactcatattatggtatgttccctgccccaccccactccactccctctcaacagggagaaagtacctgaagaaaatcattgctatgaagggcatagccagctaaatgggtgtcacttagtctgaaaaatctcaaagatgtcaataagccactcgagacaacaaggaacctgttttcctgtcatcattccttctcagtccttggctttgggaagggtaactttatggagagagaagaacctctgtggagttaaaaggtttatgaacttttttccctgcaacaaatcagtgacagctgttccacaggctgatggttttccctttacctttcgttttttaacagctatgtctcacagtccagacttggagtacaagtaataagaagaataaaacttaatcccttaagtagattcaccataagttagctcagagcaattccagtgcaagtatggtctgtgatccagtaggtgagtgactctgctgctgaaattcacatgtatgtgaatttcacagtggcctttgctttgtagcatgctgtaatccttttgtccattttcatcacacgaactgctgaatataggattgttaaatggatggggagatatcatgaaaatgattaaagaagaaagttcttatttaggggtgcatacctgcctatctgaccattgtacttaggcaatcgggatcttgctttaagaaaaggtaggcattggagtcaggctgctggagtatgaatcactatgctatcatttttcatttgtttttgctctgttacattaggaaagttatgtagaattttgtgcctcagtttcctcattcaatatgggtgtaataactgtgcctgtcttgtaggattattgtgaggcccaagtgcaataatatatagtacactgtgtctggcatctagtaagcattcattaagatgacatgaagataacacagatatatcttaacatgtaattatgattttgcttattcaaggccaagcattccaatttaatggagttaggcaaacacagtaaattcattgctctttcctttttatgctacttcctttgaagaggcagtcaagttccatttgactgattcggaactttttagcaatgtatattatgctgacttcactcttatgcgctcttggggctataattcatcaagttaggcgagcaaagaagtgtgttggtgaaagagaaatgaggaagaacaaggaagaaaaaaagggtcatgagcttattcactgccaatatttattatatggaacaatgaccatccttcagaagtgtttgttctctattatactgtaggtgtggaagaattatcattgctcaatagctgtctcagtcactacctgatagacttgggaggtctggctatttcagggcgcatttgacatacagtgacatttttggattaaagctttcatgatgagtgccagtctgggtccaaaagggttgaaagctgtcgccatctataggctagttgtttgtagtaaaatactttccctcactgcattaggttcttggtaccatttatctagcagagttcttcagtgggcttgaggcttagcagtcaagttaaaacaataaccaacatcccaaacccagtggctgtcaaatttcagtgaggtggcatagaactttagcatgaacttgagcttgggttcagctagactttcatataaatccttgtttgaagttagtagctgtgtgatcttgggcactgatattaaacctttatgagaaagttatgtctgaaatatgggaaataaaccttccacttaggttgttgtgaagattcaatgagttgtaacgattgtatacactataatgatctatattacagttgtttcataaatatgattgccttcattttattctttccttgtctcgttcttcccagtatcttacagacagcaagttgaacattgtgggatgcatgagctattgaggcctttgcagctttctgctacatggaggctagggccagagtcaagatttatgctttgcagcacactggtcagctgtttttgcaaatcagattaaatgatttttaaatgaggctgagagcatgggagatactaatgtgtgtttccttgtgagctactgcataagtaagtgctttgtaaaatgtcaggggctccaggattatatggtattactgtcactattgtaagcacttctaccttttttttctccttttacaggttaggaaattgaaatacagaaagatgaaaagtgatttgcccaagcatatagatcaaagctgtggcagaaccaggactggaacctatatctctctactaatggtttttttaaaaaaataaccttgtttcaaaaatattaaaaagtcacaagaaaggtaaacatgtggataaacaaaatgaagaaaataaaaattatccagtaataacatattggcatatgtctttctggtatattttcctgtgttgtcatcattatcatctccatcatcattatatccatcattatcatcatcatcatcatcatcatcatcattatcatcaccatagtgaacatgtaatgcttacctagtgccagatgctgtctaggcattttacatgtgttactggtaactcatgtaatcctcataacaaccttataaggtggttgctattatccccatgttacatatgaagagacagaagcataaagaagttgcaccgctggtaattggctgggatttgaacttaagcagtctaaccttagagtaatgattttaacaactatgctatatacatacaaatttacaaaataaaactgggctcagacaataaaaacagctctcttttcatgttataatactttttcaccccataacacataatcactaatgttttaaagatcaaaacaatgcacataaaatgtactggttttaaaaaaaagaggaaatagccacttacctcaaccaaactaacttggagatagattagattgataatggcaagggtgatgggtagatgggtagaggttgctcaaaaagaaacacaaaatatatcctcttttaaggatcctgatgctttgctcaaagtaatttttattcttttaaaactaaaaaaaaactgtacaaaattcatagggtacatagtggcgctttgatatatataatgtatagtgatcagatcagggtaattcgcatacccagtcatcctatagtgggtatagaacaccagaacttattctttctatgtagctataattttgtatcctttaacaattctctccctatccctcccttccccctacttttcctagcttctagtatcctctgttctactttttacttctatgaaatcaactttttcagcttctgtatgtgagtgagaacatgcggtgtttagtaggaaatttctgttcctggcttatttcacttaacacagtgtcctccaagagcatccatccaggattttattgctttttatggcttaatagtatttcattgtgtatatataccatattttctttgtccattcctttgtttttggatgcctggattgattctataacttggctattgtgaatagtactgcaataaacatggtctgtagatgtctctttgatataatgattttctttcctttggataaattgctagtaatgggattgctcaatcataccatagtactattcgtagttttttgaggaacctccattctgtcctccatagtggttgtactagtttacgttcccaccaacagtgtataagaattcccttttctccaaatccctgccagcatttgttatttttttttttttgtctctttgacaatagtcatcctaactggggtgagatgatacctcattgcagcttcaattcacatctccctgatgattagggatgttgagcattttttcatatatttattggccatttgtatgtgttcttttgagaaacgtctgttcagatcattttcctactctttaattagattgtttttactgttgagatgtttgagtcccttatatattctagatattaatctcttgtcagatgagtagtttgcaaatattttcttccattctgtagtttgtatattcactctgttgattacttcctttgctgtacaaaagctatttggattgatataatcccatttgtgtattttgtttgtgttacctatgtttttaaggtattattcagaaaatttttgcccagaccaaggtcctgaagcatttcttctatgttttcttctagtaattctatttttcatgtcttacatttaggtttttgatccattttgcaatgatatttatatagggtgagagacgggaatctagtttaattcttctgcatatagatatccagttttcccagcaccattcgttgaggagactgtcctttacccactgagtgttcttgatatctttgttaaaaatcaggtggttgtagatatgtggattaatttctgggttctctattctgttctattgatctatgtgtctgtttttataccagtaccatgctattttgtttactatagctttgtagtatactttgatgtctggtagtgtgataactccagctttgttctttttgcttaggattgctttggctgtttggggtcttttgtggttccatataaattttagaatttttttttctatttctgtgaagaacgtcattagtattttgatagggattgcattgaatctataggttgctttgggcagcagatatctttccatttgtttatgtccttttccatttctttcatcagtattttgtagttttagttgcagaggtctttcacctccttggttacatttattccttggtattttattgttttcgtagctattgtaaatgggattgccttcttgattgctttttcagctagttcattgttcatgtatagaaatactactgatttttgtatattgatatcgtattctgcaactttacagaatttgttattagctctgagttttttggtagagtcattagatttttctgtatataaaatcatgtcatctgcaaacaggaacaatttgacttcctcctttccaatttggatgtcctttatttctttgtcttgcctagttgcttgggctaggacttccattactgtgttgaataagaatgttaagagtgggcatccttgtcttgtttcagttcttagaggaaatgctagtgtagctgaggagagaaatgaaaacagaataaaaacttcagtagaagttggggagaaatgtgtttgcaccaaaagaggtgagggatggaactgagggaggtctcgaggggtaagagaggccaaagagctggcaggtgctgctattaggatggccaatgatccagaagtaatgatgaatgagaagatggattaaaaaaaccctgacattgtttaactagaagaagaagacagtcagagagaagtgagggcttacttttcatgtttaaagtctgttatgtggtaaagggattagatttatctgtgttgttccaggggacagaaataggacaaatggatgcaaatagagtgaggaagatttaaaacaaatggagaagacattctaaaatcaactacaatgagcgtaaacaatgacaacggaaaggactatttttgcaattatgtagctcttgttctctatagatagatgtgtaagcagacgctgaataaccatttactgaaaatataaataaaaacaaagcaaattgcaggcaataaatattgtattagttctcattttgtaaaacttatacaggtatcatatgcatagacaaatacaccaaactgatgaatatttgccttgtataatctttttgtagtttttttatgaacatatattactcaaacaatttagaacatttggcaatatatatatatttcatttataaaaggttaggaagattaattacactttctgaggtcgcaactaaaagccaagattttaatccatttctatttgatgtaaagtctggtcttttttcagcaaaccacaatcccacattttaagggcattaagaaagggatgggtagacaaaatgtagaggtagtaggtacagaatacaaagtttcaagaaattaaaagcttctaaactaacaaacagccaatttgtggagtgtcactggaaagtgacaaagaggacagttaagttagttggaactgaactgaggccagacagggctgtgggacaagtcagggtgtggtcattccggtaagcagcgatgcagaatcaagacagagtagtttctccttctctctctctctttaattgtaacgccttttataacaaacaaatattatgcttatttctgtctttaaattttttgtagtaatttctcatcacttaacctctattttttaaaaaactaacttttctcttgtttttctagttgagctatcattcatatttattatgtggaactagaggtagtcctggctacttgggaacagcgtggagtctagccatgtcagggccagaagtcgtctcagctaagttagaatgtgataccattgtttacacaagtgtggcctgccttcaagatagggtgaggtgttttatgaccacaggctttatgagttatagctataaaacaatcaatcttttaaagcaaacacaccacaatgtctacacgcaaatgagaattgtccttcagggctgtgaccttgggaaactcttcacacatactagcataaaacatatttaaactcttcactgaaaatattattcagacctagtttctctctcagtctctctctatgtttctctctcacatgtacgtgcatgcacgcacacgtgtgcacacacacatatgctcacatcattttaagatacatctcatttttaaccaaaaccattttatcttgcttgataaccaattttatttgttagatgacttggctataaatgcctttggctatcaggaaaatcaaatcaaaattaaaagacactgttactactgaagaagtaaaaaaagaatgggctgctgactctgaagatcatacccgaagtagagctgcaaagatatttggaatattggtaatatccaataaagaatgaccttcatgctattttgaggagatgtttaaatgtcgaattattgaaatatttataaaatacaaataaactaactctgcttcatattccaacttgtgtatgacacttcttaggctatcatttcattccaaatttatggtcactaccctactgtcattcctcatactaaccatatgatcaacagttgaaaagcagccactcgcagaggtaagcaagatatatggtaaatactgtgttgacaaaagtatgcagaagcagtcacatttatacagtagtgaaggaaatgtaaattggacaaactttttggaagataagttgagaatgtcaaaaatcaaaacacactttctgttttattcagcaattatgagccctttgttttacagctatgctcacaaatatatacaaacatgtatgcacaattatgttcactgtggtattgcgctagaaaaatactaaaaacaaaccaaatgttcatcaatagggaaattgttcaacaaattacagtatatctaaaaaaagaataatatataacaactgaaaaaataaaatagttgatataagcagatattccaagatctgccagacatattgttaaacgaaaaatctagatacaaaattgtttatagttctctttcatactatagccaaagaaaattcagaaaaaactacttacagttgatccttgaataatgcagcaggtaggggcaccagcttcctgcgcagtcaagaattgcatataacttttgactcccccaaaactttgctaatagcctactgttgactggaagccttatcaacaacatcaacagttgattaacactggaaaaggaggggttggtcttactgtctcaagggtggcaaaggcggaagaaaagccacctataagtgaacccttgaagttccaacctatgtttttccagggcaatcatacatccatgtccatattcatgatgaatatgtgaaagggtacataagaaaatgtgatagtcgtttcctctggagaataaaatgagaggtctatcataggtgagaaaataattttttattatatattcttttgtaggtttatttttttgtcatgtgtatgtattcttttcaaaataataaaaacaataacaacgattaaaatatacaaggggaaatgcattggccaaggtttagttgagagcaaagtttgcttatctttcgaaagaggtgaactaagcttttcctttttctctttgggtatacttgaatggggatggagtaagtggattctttttttttttttttttttttgagacggagtctcgctcgcccaggccgactgcagtggcgctatctcggctcactgcaaactccgcctccggagttcacgccattctcctgcctcagcctcccgagtagctgggactacaggcgcccgccactgcacccggctaattttttgtatttttagtagagacggggtttcaccatgttagccaggatggcctggatctcctgacctcgtgatcagcccgcctcggcctcccaaagtgctgggattacaggcgtgagaagtgagtgaattctaaggagtatcgagaacagtgattaaaacagaaggtggggaggtgtcataagcttatttgtaggtgaagtattaagactagaagaatgacattatgcatcaaatcttttacattgtttgatctcttttacctaaaaacaaaacaagatacttttttgttgtttgacatatgaccaattagcagccagttggagctaaatgttttcttttttctttttcttttctttttttagatgtagtgtcactctgtcgcccaggctggagtgcagtggcgtgatctcggctcactgcaacctctgctacccaggttcaagcgattctcctgcctcagcctcccaaggagctgggattgcaggcacctgccaccacgcccagctaatttttgtagttttggtagagatggtgtttcaccattttggccaggctggtcttaaactcctgaccttgtgatccacctgccttcgcctcccaaagtgctggtattacaggcatgagccactgtgcccagcctaaatgttttctttaaaagcaaggtaagtatgcctagatgcactgcctcttagtaatttttgaggatggattattcattaaattgcttccctttctcacagctggtgaattagaacgatagtgagcttacaagagctttaacgaggaaaagatggtcattgtttaacagagaaggatggtttgggtgagcatttttgtgtttttggaggggaactttgagggcaatgagtgttgcacctgtgtccactgaggatctctgggcggggtaaaaggaaggcagggatgagagtgaggaagggagacaggagggtcccaaatacgaactttgacttaacgaggatgattactagaagggaaagattgtggattcattgatgagatgttgaaccatgaaaactctaattgtagaactcacttcagactgaattgacttggctttcagtagcagaagccctttgtctacttctctagtattgaagtgaatgcaaatttctcaatgtaagaaaagtagagtggtgaaataagagtgtgggttccagggtcagacaactgggtgcataaaaagggtaaggatgctacaactggtaagccctgtgagaattatttaatccttccatgtctcattccgctcatctggaaaatgatgatcatactaacttatgagatgtgtgtacagactagatataatattaaaacatttctgatacctatgcattatattggatcaatatatatttgcaataaatgatcaactttttattaatgaagttagtacttatttcataacgagattgtttacttctaatttactagtattgtcattattactgttgctgttatactgctactgctgttgctactaactctttatgaagtacctaatatgctctaagccttgctctaggtgttgtatatgaagtatttctaaacctgaaaactatctaagatggctcagtctagcccattttatagacgaagactgaagccaagagagttgaaataatgagtaaagttgagatttgactttgtcttccaaacaactagaagcataaagcaatggaccaggttccaaagtgacagggaggggcattagtttggcccataggctgcagagcctgtgaccacagagccctatatattccagtggtgaattatgtttgggaatgtggcagaccatatggctatggcatcgttagacatgaggtggagagaggcagatgtgtggttactcgattgagttgagagatgccatggaaaggaggaagaagagcctgagagagcaacttcactcatggggagagaagcttatgtggagataagcttcacttcactaatggggagataagcttcacttatggggagacaagtaaggaagcagggatctccagaggatgtggagtatgcctggtactttcattgttctttttccttattcttctttattcttttcattattttacctaggttagatgttaaacacttcctgttgtttagtcaggcttccttttctaattataagactaaacactaagatttcatttgtagatataattattagagaattttgataaaatttccaagcagtgttccctctgtttatcatcgtgttccctgctgttattagttcacagtttggtctggaattactccagttaatcttggggtttcaggagagaaattgtgctcagggtacatgagaagagaaagtttagaaagcgaagggcttccctgtctagtttctagctcagaaaagcaaagatattctactttcatatgtatgataattggagctgagctgactttaaaaacagataatttttcttttttatccctaataaataatggtgcttacagcaatgagtgttgctggtaacagattccaccaatgggtgtggtgtgaagtttagcatttgtggattttgcagcttctgctattgtctacagcatttcctctcttgtctcggaggttcatactttctcaggcaaggacacttttaactccagataaatgtctgggttttctcactccaaggataagaaggtgggggtgatggagtggtggtggtagttgtggagttgtcttcctggcagggatttcattgtgggggaaagtctgtctttagaaaagaaatgtaaactgggcaagtagtctcatcagttaaatgatttccttgttgacataaggtgaggaaaagaagaacaacttttgggaaaagtaactgtgagaatacaagggaagaagaaaaataaggggttgaacattgaggaagacttatgagacagataaagtataaaggcaggtaatttgttctttcaatttggcatggggacagtaaaaattttttcttactaaacaaataaagcccatgtatttcttctgctctgggagcaccaattatattgagcctctaaataaagaaagtcaacatccacaagtgttctaaattccatctcgtagtgagagtcctgaaaattgcaatagctagagtcaatacttggagtatatgcataagacgtggtgtctcaaataggattaaggcctactcttggcatcttctgttattggtgttgtttctctgtattgattggtataacgttagacaaaactgcaggtcatctttgagaaaaactcagtataaacaatgaaaaaaatgtgtagctgcacatgtaatttgcatgtaacaaaaccaaaggatgctttagatagtaacagcagcctgtactttactccaacccattagttttatgataaatgtggtctggggaagtgctcgatctaggttgttcactttgtgtttttgtttctttctatcattcgggtgttgagtcacctgtttgtctgtgtcagtgtcagagcactgggtcacatcctgcattgtccaggttttattggtccctttcttaaattaaagctgattttccacttaaagagaattctgtctccttctgcaattgttcaaagtctagcatctcaagtgcagactctaaactgtatgtatatgtattgtgcaggctatctatcttcttagctttgaattctctagaaatattccagaggtgtgattcctctgttattcaagagtgatttccaaattgcctcagccaatgtgcctgcacaagttgtttgtaactcagggtgtaatgggaaatgctttagagccacatttgtggcttttgatgggaaaaaaaaaaaatcagtgtcctcctaagacttatacagtccttgaagccttttaggctattcctgcatctcatgttgcatccatacggactatttagccatattcaacaccatcctcttgctattttgttaagatttgactgttgttgttgttgtttttaaatataaatgtgtgatcacatgcacatacacagacaatgatgtgtaactcataaacatgaaaagtaaaaatttgaattttaactgaagaaaaatcagcattattcataaaaagctggtaagatattctaaaagtggaaattcatgcagaaaattgattcttaagcacttactaaatgccaggaatattttaccagcatattatcatttaatttttaaacaagtttgagagatagagatgtcttattttatagaagaggcaactggggttctgaaatgtgaaataacttgcaaaggctatggttaagggcagggccagccacgtgtctagtgtctctgacacctgagatcacacactgtatgctgggcttcaattaatttgcagctacttgttgcattaaattcacaatccttgctttcatcataataaaaacaataataatcatacaacacaactattttcagtgagctctggctaaggccatttgattcagagtcaaaaccttctatttgtatagtattttatattgtcaaaatctaataaggatagttttcatatctgacgtaaaccaaactgatctgtctccatttgatatagtgacatatcaaattgttactttcatatatcttagtcaacctctatgtttatcattctctatgttttagaaagtaaagaatttaaaattacttcagaaagatttcttcttcataaacataaaatgattagatgtcccttttaaaggcaacagcttcttctttttcttttttcttttctttttttttttttttttttttgagaaggagtctggctctgccgcccaggctggagtgcagtggcgccatctcgactcactgcaagctccacctcccgggtttaagccattctcctgcctcagcctcccgagtagctgggactgcaggcgcctgccactacgcctggctaatttttcgtatttttagtagagacggcgtttcaccgtgttagccaggatggtctggatctcctgacctcgtgatccgcccgccttggcctcccaaagtgctgggataacaggcgtgagccaccgcgcccggccaaggcaacagtttcttaatgagagagtagaaatgagaattcacattcataacaaagagtttattgtctttcctagtatactgtactatctagtagctaatctgtctaaagacatgtttcttatctattaatagtcctattaataatgtaaagtagctttagatatgccaagctgttactggctggggaactaaaaaagcttccagagttatatctagaaagtctttggggtttcttaatgttatgtgattagcaactaaaactgtgacaggaaggaagtccacatgaattgagcatctactagtttcaagatttatcattatgcacattacttataataactttgtgaagctgatattaactttacaatggataaaaagatagatgaattagtaatttacctccagtggtgcagacagcaggatttgaatttagtctgtccaacaccaaagcctccgtacttttcattaccctgcatccatctagtttaaaaaataaatgtactaggcatagtggcttgcacctgcaatcccagctgcttgggaggttgaggccagaggatcacttgagcccagaagttcaaggctgcagtgagttatgagcacacaactgcactccagcctgggtgatagacagaccccatctcaaaaaaaaaaaaaaaaaaaaaaaaagagagagagaaaataaaagaaaaatcgaatgtattgcatttcatgtctggaccacctgtatgagaaaattgggcactttctctctgaagtaactcatactaaaaacaaacaccttcttcctcccaggagcttcccaaggttgaagagaggaaccctgaagctctaatatgcctaagatgctctctggtgttatctaaaatcaaaatatatcacctagagcacttatttatttatttatttatttttgagatggagtctagctctatcacccaggctggagtgcaatggcatgatctcggctcactgcaacctccgcctcccaggttcaagccattctcctgcctcagcctctgggattataggtgcacgccaccatggccggctaatttttgtatttttagtagagatggggtttcaccatgttggtcaggctggtctcgaactcctgacctcgtgatccgcccaccttggcctcctgaagtgctgggattacaggcgtgagccaccacgcccggccagagcacttttttttcttaattttttatgatggaaaatttcaagcatacattaagtagagaaaatagtataatgaacaactgaatacttaaatctggcttcaataatttctaattttatgttctgtctaatgttgacataaagtatagtttgtatgtatttggtggtgagtacataatgggccacatgatttttaccttttaggctgtagttctacatcagtataagatggttgtttttttcttccaatacaaaatctaaagcgttgtcggcagtgacatttttaaaaacacaatatgagacgcaacaataaatcagttattaaaataagataaagtaggtatataaatatttcaccttggaaataaagcaaagtcagtggaagagtgtgaagactgtgaagattaggagcatgaaaataaacgactattgggagccattctattcccatgagtgaatgtgtattggttccattcaatgtagggaagagcagtaaaagggaataaccataaggataagaccactggattatctgagagccacagttgtcctttgccacatggagcatctgccctaggtattacagctctgtgagaaacagaggttcaaggaaagaaatttgttatttttcaattatctgcataaattctttggaacaggggcatggattataaaagatgtaagataataaaaagcatttgtatttgactttggaatgtattgtacttacatttgtctagaggtgtgtctattctggctattctctttaaaggagccattctatcgtgaacagatcctgttggagctgttttcttgttctaccaaccttcagccacctctctgtctttcatattacttattggcagggtttcaaaaggttttagtccttacttaatataaacaaaaatgtacaatattgacaaagtttcagttaagcagatgaaattctaagagttaagctgggattttccaaaataatcctgttaacagacttgaaagcacttatcagttctgtctaatgaagacattagaacaccataacctttccggcccattttctttgtcaataagcgttcttgccctgtcagcagctcacctccagctttagttttctcatgacagtaagtctattaccctcctgatctgtcttctggctcctcctacccaggatggggaaggtttttgactttactgatattctcagaacaaattttgggaagtaaatataaggttttccagtcgggtgcagtggctcacgcctatgatcccagcgctttgggaaaccaaggtgggtggatcacctgaggtcaggagtttgagaccagcttggccaataaggtgaaaccccatctctacaaaaattagttgggcgtggtggcggcacctgtaaatccagctactcaggaggctgaggcaagaggattgcttgaatctgggagccggaggttgaagtgaactgagattgggccactgcattctagcctgggcgacaagagtgaagctccatctcaaaaaaaaaaaaaaagatgaggttttccttaagagcactaacctagtatactgcacaggtgcctgtattcatgcatcccacacagaaagagaaaatacttgtctgaacttgtccataaattcagaatcctgccccttaacttgtatgccaggtttctggcatactcttatctgaaaactcactctattagaaaagcaaagcacagtgattttcccatcctgattacctggcactgttttttatttcagtgcttctgtttctttgccatgtaaatgcctgtgatttgccaggtcatttgtcctgattttagttgaaacagtgcagtcatcatacttgcagaatgatacaaaataatataaaatatattgcctttgtactaaacagaagtgcctctctgttggtgaaataatacatataaacaaaaataataattagtgatacttattgtgtgttcactatctactagcactgtattgagtgctttacctgcattgcttcattttctcctcacaatatccctattaggtaaattcagttataattcccattttacagatgggggcattgaggcttgatgaggttagttaacctgcttcatggtagtaaaagcagagcttggatttgagcacagcatgaatgactccagaacttacacacacacacccactcacacacatgcaaagagagagagagagagagagagacaactgctgaacatagacccaaggcaaaatatccttgagtagaggaacagtgtgagagtgaagctgtagtgctggttggggttaatcaggatgggctcactgggcaagaccaggttgtggggggcaaaggagatggaaaattgtgtgaagagaagaagggtggactaggtagataaaggtagtggactaggtaaataaaggtggtaattcagacatccactttaggcttcaaatcactttaggagaagtggtggtctattgctttgccctttagtagcaacatgcttattatacaatttaataagattctatccaatacactgttttaagggctcccatctcccggattagagctgagttctaacttccttttccaatgataatgatctgagaaatttccttcatgttgcactttttttttctgaagacttgacattgatggaaagaagtgaaacccacctatgcttttgattttggtgactaatattaattgtcatgtattactaatagtgaatctgcatttttaaagtcttgttggaaagcacattaggtgtgtatataaaggtattaaccttgaaagtatgaacgtgttttctataattagtcctatgataatttaaaatttaacatgtgcttgacacatttgataaaggctttgtctactatggttttatttatggttgttaattaagtaggagcagcagcatactacttgaaagtatgaaggtgtcctctatagttagtcctatgataatttaaaatttaacaggtacttgacacatttgataaaggctttgtctactatggttttattggaatagacaacttatcttttcttaaagtatattttaccttggtaccaggaaacttgagaccaaggtaaaatgtaatactttaaaaaatgcctaaataggaactgtcatatatagttatatttagggttgattcatattttgaaatatattctagaatataaaaactactatattttacaattactttaccaagctctctaataatacctgtttacctttaaaatcttggtctttcccacagaggacaagttattatatttttaattgttaagccttctgatcatatgaattcttttcatatttcattgaaattatataaaacattttacttcaaaggaaaaatgttatgaatttataatgcttttagaatttaaaaatctgtttcctattttgttgattaagacagagaagcattgcttgtgaataaatagcatgctatgttgaaaagaaaattaaggatcctgatgtttctctgccagataggacaaaaactaaggacgccacaggaatttttcaacatttttaacctcttgacaatatgtgggtcgtataaaggacaaatgaatgtttggatggactgagaatgccaattttaacagattgtccaatcactgtagataaatatttgtgttcctggggattatctgattattatcaagcaaattgaattggaaacatagcatgtattaagtcattactacttattgtctagttctttttctcatagaagtgtctatgtactagaagagcactaagtcatcagttagacatgatctttatcatatccagacaaaaataaaaaccttttaagaagctactttacaagacaactgcatagctttcttcacaggaacttgttaaataaataatgattattaaagcaattgggtcagtctcttacactaatttaacaagagcagttccaagatgtctagcccattccacattccgtgtgactaaccatggtatccagagcttggaaaatatccaggcaacccacagtagcttttcttaaatgcattatggacactggaatgtaaggaaagtgatagaactaggtgaacaagaagagagtctttaaggcatacccattgtcagtgtcgtaaatggcctcaattgtatgttgaacattgttcaaaagtacccatggctgaaacagtgtagatttagctcctatctgtattgaagttgataaatgcataaatcttaatcattgacatggaggtttattgtattcaatgagacagatatacttggagttttccacaaaccaccaataagagtctattgtgaattggaatgattagcttttaaagatgtatacatgttaaccacccttttatattaagttggtgcacaagtaattgtgctttcaacggcaaaaaccacaattacttgtgcaccaacctaatacttacagttatgccaagataggggtagaagcagaaggaaaatttagagtgagaagatagagacaagagatagggaggacaggaattgagtcaaacaaagattctggaaagtctgtgattaattctgtggttgttaattaagtaggagcagcagatattataaaactcaatatacaagtggtcaagttcaggaagagccaaggaggagaccagttgatattctaggtccatgtttcttgtaagcaaagtttggaaaccagaactttggatctgtttcaagagcccaaggtaagaggctttagaataaagtctaacccaggccaagaatctgggtaacagaaccagggatctcctagggcactagcactaactggtggccaaggcaagtacttctacatttcctgctttgagtccaaacttgtgaaaatttttagaaggcctgagcccacagatttattttttcatcaattcatatttattaggcacctatatgtgccaggcactgtattaggagcatggactattggtgatctcaatggacatattatccgtttttataaaggagatgtatcgtggaccagtaaataaagaagtgaacaaatagcactagaaggaaataaaaagggcaataaatcagataatctaggggagggtgttttagatagaatgatcagggaaagcctatccaaagaagtgatgtttgagaatgagaattaagtttgagaatgagcagatacatgaggagctggaaggaggacactccaaagtctaggccaagtggaaaggcttggaggggagaaaggccttggcatgttcaaggcttggaaggaagtggatttagacgctagcaagcagaaaagagagggtgtgacttggggcatagagaaattggtaagagccagatcaagcagtgggaggggaaaagccacttagctagagtaagggatggaccaagtactctgtagaacagatatgaaattattcagtgtttttatagctgtaaactggaaaatagattacagggacttaaaattctccctaagtactccatgcattgtgaagggtttactaatgaaatcttcttagagatggaaacatgaggcagaccattagtgctagatcatggtggtcatattagttctggggagtccagggttaaaaaaagtagcttcagggcaaagcattgcagttcaagagagtggtggtaatagccagagagttttgcctttggatgatgaaactggttggcaaatgacagtggagcagggtagtgaggcacccagggtgggctggtttgaaacagagcataatgtgagtgaacctgggatgcacatgaataataagatggaagaaacataaagcatcatccttcttaggatttcctttcttccacagagtcagctaagttataggtgccctgaggaggtcttccaaatggttaacagtatattatgctcttcctttgaatttttagtttgaaaatttgttaatagccaaacaatagtaatgatatccttaccactctttggattgaatgatgtcccccaccaaaccaaaacatcagttaagtcctaatccccagtagctcagaatgtggtcttatttggaaacagagtcattgcagatgacattagttaaatgaagatgaggtcatactggaatagcatgggccatttatccaacacgactggtgtctttacaagaagaggaaatttgaacacagtgggaagatggctgtataaagatacaaagatggctgcagtgagtcatggtcatgctactgcactccagactggacgacagagtgagaatttgtctcaaaggaaaagaaaaagaaaaaaaagctaggcatagtggttcatgcctgtaaccctagcactttgggaggttaaagttggaggatcacttgagcttaggagtttgagacaagcatgggcaacatagcaagaccccgtcttcgcaaaaaataaaactagccaggtgttgtggtgcatgcctgtagtcccagctactgaggtggctgaggtgggaggattgcctaagcccagcaggtcaaggttgcagtgaccagtgatctcaccactgcaatccagcctgggcaaaagagcaagaccctgtcaaaaaaagaaagaaagtagaaagaaagaaagagaaaaagaaaacaaaaagaaaaaagacagatacagagctgcagaaggagaatattatgtgaagaaggagacaaagattgaagtgatatatctattatcaaggaaatgctagggcatgatgcctgtcatcacaagctgggagatggcatggaacagattcttccttagggccttccaaaggaaccaccactgccacaccttgacctcagaattttagcctccagaactgtgatataataaatttctgtttaaagccacccagtgtgtggtactcattagggcagccgtagaaaaggaaaactaccccttcccattcctcttgtcgtattcttttccaccgttttgtctcacacactacaatcgatgaaaaccaaattgctttttctaccacttgtactctttcaacccagaatagcctcctcttttttttttttttttttttttgtctccagggacctattttaaaataagaaaaaagtttttaagcatagtacctgatagttttttaatcttcacccacacccaccccttccccataacttttttgattgattatgaaatatttcaagcaaacacagaaaataatatgacagtattcttctaaaatctacattcatcagattacaactttttgccatatttgcttcaaatcactccttttcaccctaaaaagaaaatattactgagagagagaaagtctcctctcttcatactttctttcacttcactgttcgcatccttaatttttatttatttatttttaattttttttttagagacagggtctctttttgttgtccaggctagagtgcagtggcacaatcatagctcactgcagcctcaaactccttggctcaagcaatcctcatgtctcagcctcctgagtagctgggactacaggtacatgccaccatgccccactccaattcttatttatttttaaagtggcatcactttgttagtaaagccttcccattatcactcagatttacttaactctatcacctattcccacaatattttatacacaaattatattacaggaatgatcatattgtattttaattgtagtcactttttctctataagaaaaaaatgacttggtcatttttaatcatctagtgcctatgcaatatctaactctgggttaaactgaattttaatataatagtgtttacatcgaaccgtttgaccttcaaaagagccctaagagtcaggactagaattgtcattctttattccagaaatggcaactttatgaattttacgtgtttaatgtggtcgattattgtttgtcactgttggtgaagtttacttccttgccctcctgatgttgggcttggccgtgtggtttgcttaggccagtggaaggcaggtggaagtgacaacatgtcagttccaaactgaggctgtaagaagttcacatatttctgctttcttctttgtgcttctgacattcaccgtgaaaacattccctgagtagctgttggtcccagaatgaagagacagatggagccaacctgaacccaacttgaaggctgaatgccaacaaacatagcaggatcacagcaaacctgaagtgaatgctcgctgatgtcagttaccaagatttggggtggtggttacccagcattagcatagttgaaacctcactaatacacctagatggttgataataaaggcagaactagaatacacgttatctgattagcaatatagtgtctttttactaaattattctgttattcatctgcacattcaacaagtatttaatcatatatttactgtagaaaacagcacatcattaaacagacagactgtggtctctgcccccaaggagaatatgtttctagtgagggaaagagatacaaattcataaatctaaactatagaaaatggcaaactctatagcacaaatgtcttttgagagagaataatgggtgaggggaaggaaaggagatgaatacctttaaggtggcaggggtagagctctttgagagactgcaaagcagagaagatgcttcaagaaaaagaagtacacatttctctccctggaatggtctcagtggtctcagataatggtttcagttttccatattcctttatttatgtagtgtcaggccaacagtgtactttagctccaggctaaccagttgtccttggtttgcatcccgtgtattcagaaagctattggattgttttgtaagttcttaaagaaggactgaaaaaggcttcattttccctttttccaaagggagcaattacatactgtcactggaataataaacttaagtcctaggctgcgaatgaaatttgatttctctcaggtgagaggtattttgtatatggaaagctaaggaaagaaatgcaatgttttttttttttttttttttttttagcaatccagtagggaactgtggccagcattgagctgataaagacctttgttttccatgttttgattggcccagtgagaagcctcgagcagtttgcacacccatctgtgtccatactggtggggcagaaaagtgctgacacaggattgcagattagcccctgcagcttgccagggtaaacttgtgtaatgcactgtacaccactcctaacaacagtggtccttttgtcacttaaacagaggttattaagaatatgagtcattaaaaagagctttagaaaagcaggcaacattttccaatacagtggctttaggggatctttggaaagtatcagaagttccggaagaagtaaagcatctcattaataactaacaatagacacagaatcaaaatctgaattgatgaaaaaaagtaatatttaaaatgtaatttttgaatgttgaaaagagcccatttttgtagagaattggatgaggattaacttagatattttcttgaatgtgtataaatattacatataagaatactttcaagtcttaaattggcccggggatctccagcttgctgataaaaacaaatcaaagaaactacctttaggacttctttttcttatttttgaaacattaaaaagttgcaagtgccggaataatggggaaaaagtctttattctattatccagacaaaaagctggtcaacattttaatgctgtttctgctggcatttttctctacaaatactttctatgtagttaagatcatatggtatatgtaatcttgtttcattcattttctttcacttttgttattccttattcagtgattggaaaactatggtttataggccaaatctggactactgctacacgtggaacacagccacatgcattcatttacatattgtgtatgactgctgtctctgtaccataatagaattgagggcggctacagagcttaagtgactcacaaagcctgaaatatttgctctctggacctttatagaaacagttttccagtttgtgagatagattattagagtcatatgaacacaatagaattttacaaaaatataccaaaagtttatacagccattgatactttaactagcattgtctgatgaaactgttttattgcctataacaatatatatggtaaatatatatggttatgcatatataaccatatatatgtaatagccagctatatatatatatgtataattttatatgtatacagttttggattttaatagacatagaatgttagtgtatctcttttttgctttaatatttatttctttgagtagcagttagacaaaatgattttccatttttttagttctttaattttctttatcttcaactgccttcttatgacgtttgcccctttttaaatagagggtttttttaaaaataaatttgtaagggctctatatagatgcggaataccaactcttattgtttttactttgactatattttctcagttttttaatcctttaatttgagagatttttttgaaacttgaaagttgtttaatcagtgtaaaatttcctctgtgattcctttccaagctccaatatatcatgctgaggaagtatcttatcatttttaattttttaaaaatttataaggattgatattttatgaaaggcctcttgagtgtctatttttaaaaacatactttgttcttagaatagttttggacttacagaaaaattgagaagatagtacaaagggttctcataaactccacagtgatttttccctgtcattaacatcattcattagcattttgtcattagtatctttcattagtattgtatgttcgttacaatcaattaactaagattgatgcattgtcattacctaaagtccatattttattagaattgtttaagtttttacctaatatactttttgttctggtatcttgtcctagataccaccattcaaccattcatttagttgttatgtctccttatgtttttcttggcttgttatattttctcatagttttttggtttttgatgaccttgacaattttaaggagtattgactaggcattttgtaaaactcctttctattagaattggtcactgtgagcagtccacattttaggaataggaagttttatttccccatcttgagggtgaagttgttgcataaacttttggggattcttctgcatgggagattttttctacttctccttttatttatttattcagtcatttagtatgagctcatagatattaattttatactttgggttataatctaatacttttttattattttgttgcttacatacttctagatttggccactgggagctctttcagttgacttccgtatttctttgacataccttggcaaatgtaggatttgtgtgtgtgtgtgtttattagcacatttttcatttctggcactacaagatcctccaggctcatcttgtttatttcctgtgccagtcctaggattagtcatttctacaatgtgccctgattcctttagtcagtttccttttattaggaaccaatatctggacactggttatgcttatttgtacaagcatgtagttacttctgggccctctcagcttacagagcaaggaaccatactatgctatgtgtgtgtatgctaagctgtgtatacacacacagaaaaaaatatatatatatatatgcacacacatatatttctatacatagccatctgtatcaattttgagctaaacatgagtgttcatactggtgtctccaactctaatccagtatcacatgtatcattttagccttatccccttgtttatctgtacactcccatcccaacagtgataatcctggctcctgccatctgtcaattccagtatacaggtattggaatatcagaatttttaacttgtactctagttattttaaccaagaaataactttgttaactagagtacaatgcttatgtactgtcaaacgagattccactcgtttccaaagttatttaggttcctctcctgatttttaactcttatttcactgcattttaatccggatttatttattgttcctggttgtcagtcctgaaactaaagtggtaataaaggaaacaggtggtatacgtgagaggctttcaaattccttgaggtcataaaatatatatgtatgtgcatatatttaaaataaagccttgaacaggcagaaaaactgatattgcattgtagataacaaatggcataaaacacttatgtagaattagtcccatcaaaatatgtaaagaagtaaggttcgataaaagttgtgggcattataataaaatatttctctccctttatattcactccttacctgttctcagtaaaataagttcaactctgtacaattaattttctgccatgtctactgcttgtacttgggaacaaatgctatattataatataaagatatgtgtggaacttggtttcaaaagtcaggtaatgcaaatatcaaaaaacaggtgatctctcaaacaccttatgataagtcagtcagataaagtgctctgcagaactccagccaacaaacaggttgattatcagtgaagtatctcatattttcaggtagtcctcacactaagaaagctaatgaaaaagagtttgagctcacataatcatgagaaagtacatttcaaaccaccttcccaaatttcctgctgcagtttcttctctttttactcattatttttctttttacctcagtttactttctggttttcttggctgagtgcctttttaactgctttgaagtaagatgctatcttctttatcaggtttgcaaactatttattgaatttagcaattaaaattgtcgctgtggttgaactggaaaatgtccttttggtacttgaatttactgaatataatgactgaaaaagcatttcaaacaaacaaatcaacaaacaaaaaatctcaattagtttgttgcatagacacaatagtaactcacagcactggcatattatttttgattcacaaaacacatatagagcctggcatctattagacatggaagccacttattaagtatttatttaatcaatgaatgcatcaaaggattagtaatatcaacttcaacacaatcctgtagtatatgtaatattcttcctcttccctacctttaacaatgaggaatttgagctcagaaggattaagtgaattacttgaagttatattattaattaaactactgaagccagaacacgaatctagaacttaatcatcagaagggcaactactacctccacctacgttactcatgatagtattaacatggtagcacagtggtacatagtagttgctcattgaatattatttagtaaaagaaatgaaaagagtggtgctagatacttggaagaataagaattctaagaaggagaataaaggtgtatatacatattcatttgataagtattcaaataatagttaaagagatgcataggatactgcagagctctttcagaattgagaagctgaaattaaaagatgtattagacttgtttccatcttaaatcatcatcatatcaagtgatagacattggtacctgcagtatttcagtggcatttgatttttttcctgcagagttctattaatacagtattttaaaattttattgtatgtcatttaaaaaatacttttaaaaagcaagaacaccacatttttctgggcataagagacaaggttgctttttgcatgcatgtatgcaattctaacctttaaatttcctatgtctttattttttcccctgactttagagcctaatattgactaacagctcattttgaaagataaaaatccacaaaataataatttagaaagtgaaaatgaaaaattacattaatttctcctctaccattgtttttcgttcaaaaccacagttaacatgagttgatttattttttttaaatgaatctactgtgaccggccttatgatccacccattcgcctaagtttgaaaccacattgattcagtcaacaaactctataccacctactaattgataggtaatgactagttttgttaatacttggttacagcgatagctttgagcaaattttcaaagtgaagcttttctcaactttttcttgttgattcggtatctgaaatagcttattaattcattccttccttgtttccactgacactgccaatcagttgtaggtgaaaactctaaactggtctcctgtactttactatcccattttctgccttaattcatcttctccagtgtctcaagtgtaatcttgctaaaatacaaacctaattatgttactcctctgtttacagtctttaaatgttttaccaaattaaatccaaactccttgagaagttcatacaaggttgtatcagagcctctgaaacgctaacccacatcttcacagcttcatctcttgattccagcctggatgcaatgggcattctggatttgactcatattacaacaacaaaataatctcaagtgaataccatgcactttttactttttttccactgggcttcttcagtgccacacctgggaatggggttttacttgttaagcttacctatggagctccaaaatgcaaggaagtttaacttttgagagcaatgtccaaccaatgagggatggaaacataggaaaacatgctttcccaagttattcttctaacaaacagctctaaggtacgttctgtatgcttattccccctagatgtcagggttgagttccagtgtcccaaagctatataataaaaatgcaccttggtatagactttcccgccttcccttactctctttagtctccttttgtactccataggattatctcattgactgggctttgctttctagtagaacctaagctatgacatatagtactagactctctcaccaggagtgatttaggacgaggaggcgttgaaaactgaagctttggacatctcagatagttaaagcactcgcaatttctggcatttatgtgctcataatgtagtggtgaatggcaattgcggcaaccatggcctgacaagagcaaggtcatcaagagcttagattgtttggagctgaaggtctgagtcaccccattaggctaaaaacctagaaaagtagaagtgctgatggagggtgaggaaaatctaatatggattgtggaggaaggagacgatacatataaaacatgactgcaggacctgcagttgtagcagtgagggctgtaacttattccattaatatttgtgtgttaagtcacatgtagagattgtggctaactaccaccttgaagacttagaggttgctggaacttattctagggcgtaggtgtatctgtgtggtacaaaggatagactgtatgggttgtttttggctttctgactcatatcctcttggcttcatctctgattacagtgtagatgcagtgggtagtttggcttacgtcaggctgacatctttcctcaagcactggatgttttgcacttttgcccttgggtttttccaatgccacaattgccattgggaagccctctgttcaagcaggcatgctcagtcgagaagccaacaggggtttacatccccaaagcaaaccttaactaatggaggatacaagttgatggataaaaatagtcaaaccttaagtacataattccaaaaggtattctaaacactccttagaagattccaggcagggctgagcacaagttgcctacaatggtgatattaataatgcatctatatatatgccttttcacattccctccctcttctgtctctcactcctgctccctgttcataaatttttgcagcaggctctgcttttgggaaaactcaagctaaaacaaaagtccttaaattccagtatgcctctgtcctccactttctacccaattttgtgttgtttcttttggttgtttccctgatatatgccaagaaaataaatggagaaatagaagggtgggactatcaacaaatactttaatagaatttccagaaggacttaagctgtcagattgaaaggatccactaagtagcccagaaaatagtttaaaagttggttgttttgaagtttttttctccctggtttgttttaatctctacatctggtgtacagctgtcctcatgagatgccttgttactattattctcttgtgccaaaacttctatttcttatccctgtaatgttttctttcttggagcacctcctaaatagtcttagaaaggatgcatgggaggtaacttttttgaggcctcaaacatctaatgaagtctctattttatttcctttgacctgattgaatgattatggatttataggttagaaactatttctttcaaatacatgaagggagtgtcttattttctgtgttgctattaaaaagtcctaatgcaactctttttatcattctgtgtacagtgtatgtgattttttttcttctctggaagcatgtggagtcttctttagtcccctgtgttctgaaatttcaacagaaatacccttattaaggtctgctgcttggtttctattctccatgttaaaactttccacacatgtttggtaatccttggaagtgtttaaattttcagttatcttttaagtaagttaagagaagaaaaaactttaaaaaggcagtttttatgtttactcatgtatttcccatttctgttgctcttcattctttcctgtaattcttagttcccatttaatgtcattttcttcacctgaataacttcttttactgcatattttctgcttataaattctctcagtttccatttatcccataaagtctattttacctttattttcaaaggatcttttcactggatatagatttatggttgacagtattttgttgttgttgttgttgttaatttacttcagtacttacatatattctagtttcttctgtctccactgtttctgatgagaagtcattattggtatcagtgttcctttgtatataatatgttcttttccctccagctactttcaagagtttccccttgtctttgttttttcagtttgattgtgatgtacttcgttttctttatgtttatcctgcttcaggttccctgaaattcttggatatgtaggttgatgttttaaataaatttttaaacattagaccattatttcttcaaatattttcttcttctcttcatctaagacttcaatgatatacatggagactccttgatattgttccattgtcacaaagcctttattaatttctttcaatagttttttctttttgcagcttgaacttaaaattcactgcactctgcacctccttttccccccgtgaagtctccaatccattgttaagctcattcaggatttctccacttcagatattatacgctgtagttctaaaatttccatttttctgctgctatcccatatgcattcactgattatgaccataatttctatacatttttgagcatatttataataagtgctttaaagtccttttctactaattatacatctggggcatttcagagttcagtttctcctgactactttgtctcttgagtatgctttttcttccagtgtctaataatttttaaattatacacaaagcattaaagataatttgttggccaggagcggtggttcacgcctgtaatcccagcactttgggaggccaaggcggacagatcatgaagtcaggagattgagatcatcctggctatcactgtgaaaccctgtctctactaaaaatacaaaaaaaagaaaaaattagctgggcatggtggcgggcgcctgtagtcccagctacttgggaggctgaggcaggagaatggcgtgaacctgggaggcggagcttgtagtgagccgagatcgcgccactacactccagcctgggtgacagagcgagactgtctcaaaaaaaataaataacttgtagagattttggagtctgttacctttctctgaagaatgttgatttttgttgtagcagcagggcatcagtgaaatctctgctcggtttacaagtctttttttcttttcttttctttttttttgagatggagtttcgctcttgttgtcttgttgtccaggctggagtgcaatggcgtgatcttggctcaccgcgacctccacctcccgggttcaagagagtctcttgcctcagcctcctgagtagttgggattacaggcaggcgccaccacacctggctaattttgtatttttagtagagacgtggtttctccatgttggtcaggctggtctcgaactcctgaccttaggtgatcctcccatctcagcctcccaaactgctgggattacaggcgtgagccacggcgcccggcctagtcttttaactattgctatctgctgggctttttggagtctctaccatgcatgcatagtccagtagttagtcaaggatttgaagggagttgatacacagattttgtggcttcctcctctgtgcgtctctcctttcagcaatttttctgtttaaattcagtcaccctggaatccctgagctcactctctgactccacaactcagaaagacaatgactttctttatgaattttagctaccctgcatcacttgggctgcaagatgctctccagagaaaatctacattaaaacatgtcactcaatgcagttaccttctttcaaaggttgaatcaccttctttttgaatccctgttggttgttattttgtaccttaaataattatttttaatactggtccagagtttataattgttatctatgaggagtgttagtctaacacaagatattttgtcatttctagaacaagactactccactcttatgtagctgtgacattgtcatgcatttctttaaaacattttagtggttctttattgtttatcaaatagaaaatattccttaaactgcatgtactctattttttcattgtttcccataacaaagaaatattatttcattgaaatattgaaatattgagcatgccttcaaatattatgtttcaccatgttcttttgctcataccgttttccatccagaatacatttttccccctacatttgaatgcccaaatcctgcctattctttaagatctagctaaaatgtcacctcctccacgaaagctattcttctccctccagtttcagttttgactaaattatctgtttctatttcattgctttacttatgttttataaggacaataagagattagtgcccttataaaagagaccccacaaagcttccttgccccttctactatgtgaggacacagcaagaagacagccaactatgagcctggaagcagggcctcatcaaaccttgagcatgctggtacactgatcttggactttccagtctccaaaactgtaagaaataaatttctgttgttgatggctgggcgtggtggctcacgcctgtattcccagcacttgggaggccgaggtgggcgaatcacgaggtcaggagatcgagaccatcctggctaacatggtgaaaccctgtctctactaaaaatacaaaaaattagctgggtgtggtggcaggtgcctgcagtcccagctactcgggaggctgaggcaggagaatggcgtgaacctgaaaggtggagcttgcagtgagccaagatctcaccagtgcactccagcctgggtgacagagcgagactccgtctcaaaaaaaagaaagaaatttctgttttttataagccacccagtctatggtactttgttatagctgcctgaatggactaagacacaatgtgaaagtacattatcttctttttgattctcaagttaccaccttttctcaaacgaccaccaactctctctggacttctgaaatattcttgtaactggtctctctgcttccattcttgtacctttaaaccttagtattccacagtagcctaagaggtcttagggtatataaacaaaatgacgttaatttcctgcatctaatcattcaatagcttcccattgcactaaagtggaaccctttctttagagtccttgccatgatcaataaggtctcctctcctacaaggtatgggcactgcctactactctgacctcatttattacactcttccctgccttaacatatgccaaaagtattcgacctttcccccaattctcaaacactgcaaaaaaccctccaaaggcctactactttacagttgctctatcttcttcctcgaatgccctccttatctttatagatggctccttcttttaagttcttagtaaaaatatcatctccttagagggaccttcaccccctcagtcacaaccttgttttaaattcctcagaccctcatgattatctgaaattatcttattatatttctttctttgttgtttaatgtttctctctgtcacaaagcaatacatttttttttaaagcaggaatgggctatatattcttcattttgttgacctctaggagctgcatcagttggggtcccctgcctctgccctccagttgagttcagttaagtaaagaccagaggataagaaagaaggctactgtgtgtttctactgagggttatagctcctttcaggcagtcctcttctacagcttttgggttccataactatttcttctccttgatgatctccggtaattcaacttggctccttgttttctctttctgtcctcctcactgttgctagccttagggtgcttcagtttcccttaacgcagttcacatcttttaaaaacagactcttcattaaattctctttaatgatttgtttcaagtatgacaaatctgtctttctgggaccttgaattttattcttcaaaatattaccagcccttagcacagaacctgttacatggtgacgttcaacacatatttgttgaatgaatggatgaattaataggctcttttgctcttcattcagaatctattaagctatacactccctcagtattttaaacccaaaattcagtttttaaaaactaaacttcttgagagcatagtctatctatatctctttaaaatttaggcctaagacaggacactgccccacattgagtcccacacaacaacctgtgagtctggctccccaggagggcccccagacagctcccaggcacttcataggcaaagcctgtcccccccactcaggattcccaaggtctggggtcccgctcaccccgctttcctctcatgcccagcctgaccccaggtttcagctgggagaggccacttcccttagccaaggaaaacgagaacccccagggtacaggaggaagctgggacaggtccccttgggtgtcactccctcaccccctgcccaggcccactcccactggtgctggagtacgcactggtggggggaccctgctcagcccagcctggagggccccagtgtcaccacaaccaggggcacggcaacatcattgatgggttctgcagcccagggcccccgatgcggggtcagagtgtgtggggcacagggcccccgatgcggggtcagtgtgtgggggtgcagggcccccgatgtggggtcagtgggggtggggcgcagggtccccgatgcggggtcagagtgtgtggggcacagggcccccgatgcggggtcagtgtgtgggggtgcagggcccccgatgcggggtcagtgggggtggggcgcagggtccccgatgcggggtcagagtgtgtggggcgcagggcccccgatgcggggtcagtgggggtggggcgcagggtccccgatgcggggtcagagtgtgtggggcgcagggcccccgatgcggggtcagattgtgtggagcgcagggccccctcgtgtccagggcactttggtacactgtcccacaaggcacctgtctcagaggaggggtcctggcaggcagtgtggcaactcccttccagagcccagctccatgctaacctgcccacagcaaccccacagagccacatcccctgctgcacctggcctgcaggagtgtcccaggacaggcccaagtcagcccagcatgcagctgccctcctaccctgaagaagggagtgggctttccaggggacataaggatgccaggcctggacctcctgggcaggaaagggagcaggtcctgagggcctgtgccccacagccccagcaccaggtggactgcagcgcagtgggtgggccagtggcagctggggagaagccccccgtcagcaggctggggtctgcccaccagggcctccccacgtctgcctttgagggtgcctgccatgccctgggggatcctggtatctttactggactggaagcaggagacagaacagtgtctgtcccggggtgacttcatcaggagaccgcccacatagagctggaccccgcagctgaagcggaaatgtgagacaggctggcacctccggaaaaactgcctttcagccttggtgttccgtgcaaggtgaaaaaaaataggtcctccaagtttacagcttgaaatcaggctactgtgtggccctggagaccacgaggggagaatttaaagtggccccggctggcagggtctaggtggctggcagaggcacatgcagaccctacctggagcccgccctagggacgctgggcaggtcagtctccgtgcaggatgtgagcagcgtccctgggctctatccgcgaggtgccagtagcgtgtgcaggtacatacacatgcgtgcacactgttatgacacccagaaatgtctcaggacgtcgaaatgtgtccttgggagcagaagtgtccccggttgagaatctgtcccagaggaacacgaccacgacaggcctcaggattttgtgttgatcaagttccaaggaaaaggaacatctcggccaggcgtggtggctcacgcctggaatcccagcacttgaggccaggagttcgagaccagcctgggcaacgcagtgagagacccccatctctacaaaaaaaaaaaagaaaaaaaaaagaaagaaagaaagaaaagaaaatgagatctccaggtttaaaaattcataaacaccacaaggaaacaatacactatgagatccagcagaagcaacagattgactctgtagacccagatactggaattatcagagagaatataaagtaacagtgttttatatatctaaagaaataaaagagatttctggaaaaaaaaatttaggcctaagaattagtgaaaatcccaacattaaggaagggattatatgttcagtttttgaaaggataatgtgtcatttttaatatttgctatttcctggaatcttagttctaggatacaccataaatgtctgcttttataggtgaagaaactgagggtgagaactgaagagggatttatctgaagacgttatggtagtggaaccaatttttactttaatgttgttgctctcttgatgatattagatggtttcatcaattactaagtaaattcccaagatttacctcgaagtcacattaccctattaacttattctccagttgtaccaatttgccatttcattctggtaacaaagctctcttactacaattcagaaaatatttgggaggcagctgccactgagcccagactttgacaaaatatcctcccacagaggcccagttaaactatggattgcactgagcattctgtccttaggtgctctggcctcccagtagatagcggatgctgtggtaatttatcacaaccctctacccctccgattacctgccaggtgactcttcactcctggcttctgcagcctctgctctccccaagatccagctctctcagccccccatctaaggttgcacagtttaggtacatgctgaaatcaccaatacagaatcgttttaaaattcgaattaattggctgagtgttttgttaagacctgattgtgggcaagaactatttgttaaatactctaaattcttagaacccagcccagtacttgctagtcatcatttaaatacattgaatgatagagaaaattcttctgatcacaaaccttataccagcgttgtcaaaattataatgataaagtagctcattttaagcgcgtcctgggttgggaaacttaacaattttaaaacttggaataaattcaataaaatgacatagtatggttacaatgtctgtctacagagtcagggcaagaacaaagaaaattgaaagaagattgttttagtgtagtaaaattactggataattttcatttcctttgctctttaaagaattatttgtaaagggtatttgaaatgaaaacaagattggagaaaaacaacttggaagaaaatcataggcaaataacaataatgattgaagagttgtgaataaggagagttaggaatcaagtggttccaggcttgcagaatctgaaaggagcctagagtgaggaggttgatctgtgaaggatgatgatgatctccattaaggaccagacaggaggcaataggcttaagctgcagtatgagggatttagataagagaaaaggaaaaattttcagacagtgaggttcatagatactggaatgtgtaactgaggaagcttgtggaatttccttctctagaagtcttttaaaaatagggcagtgtctcatctgcctgaaggatggactctatttgacctctcaaattgtctactgaactcagaaggtgaaccacaccttagataagaaagagagcctgaatgatcctgggtagcttgagtaataaaagtagggtgaacaagtcatatttattttgatttatatatgtcatatatgtaaattatgtctgctataattcctttttttctttcaattgaatgttttcatttttaaggcctagagattagagttcaagtaaagatattataggaaagcaaggaagaactcttttatcttactgtagaacaaatttttagaggaataaaaggagaaaaggatatattggacatatttgattttgatttcactccctattctaaataaaaaaaaatacactgccctttctgttagctttagtattttaagggtaaatttcaaaaagttaatttagtgtaagtgtttctcacggtgtttttggcagaaccggtatcccaaactggaagaggttctctgtatttaatttcctctcaggaagtttaccgtcagaagtccaaatgtgaggtcaagttttgggttgccggaaatggtaatgtcctttactgtctgaacacccagacaacacttaatgaaacattctactttgtggacattgaaagaaattaaaatgctttgtttcctcctttttatgattggtgatttctgtattcagtcttctaaaactcagaaacaagactatgtgtaagtaagagcatctgcattctcaggatcaagttataactgcagattttcagttacaggtgatatccatcttttttttccttcctaaaaataaaaatgtacttacttcaggccaaaggagaggcaagctttagaactcattagccttcaagaaaaacaattccagagcattctaaacctgatttctttctaactctgtttgagttgacctgaggacttttacaggttaaagcagtgagtcattatatctcacattcatacagctctacatatttgtcaaagtgcttactcatctaatatctaatatgatcttaataagaaccttgtgaatgtcattatcttatagatgaaaaaatgatatcttcataagatacagtttgctcaagatcacaaaactagaaaatgtagtttgaacacttctgatttcaaagccagagtcttctccactgccccatgctgtactgtttttgagaatttgtgatttcctggtgttgtattatttttaccattgatgagatttttgcctgtgatttatcctgaatcaaaatagatactgtgatatgatactaaagtaattgttaccaaacaaaaagttgtgctagcattcttatgaagtacagcactaaagattttcaaaacattttgttatttttacataattggtcatgtaaatttctggtaggacactccttatgagattacaacccattctaatttatgctagctatttattgttaagcagtatgttgtttttattacaaaacctcctttaatcattgcatcagtctctggcagaatattaaaaacaactcccataatccctggcactctgtcctgggtgtctttgggggtacagtggctttatttccttccctaatagttcggaagtttgtttaatactgactcagaggaagcattctagctgagtcctcacatggtcttgtttacagctccggagtgtacataatagataagctactgacttccacaagacccccacgcttcctgggtgtgtgggtgtgtgtgcttgtgcttgtgaattaaggttgtgcaatctccctgctagctgcatcaggttgcaaagtcatttacttctctaaaatattcctctagccagcctgacttgataaaccaaaatcattgtattccatggtggacatgctggtaactcatgataaacactaaaaatcctacgggtttataacaagataaaacctgatattggggcagggtgtagagaaatttgcccaaggaaatattgtgaaataaagttgcaaatggctatagatgaatgcttttctatctataggatttcttttcttgattgtaattataaattcttttactggttgtaaatataattatgattcttatgttacccagtctgtaccaagaactttgttaggccaacaacatcttacttgattgtagtagtaaccttaaaagataaatataggtataatgctttttcagaagaaaaactggagaattcaaacatgttctgcattgcacagatggtaaatgagtgatgaatagggtcctttgactccaaagatcaactaggttctttccacatatctctctttggttcccttttttgatatgactgtatgaaatataattgtatttacataaagtgcagtagagttcattagaaaaactatttctgaatcttagggttcagactaaaggtgtttggaggctgatgatagtgggctgcaaagagcttcatggtgggctgcgaatagcttcatcaaacccttgaatgtgtcaggaaaggcagattcaaggcagaaatgtcacatggaccccagataattcttgcctggaggaaaagaacatatacataattatgtgtgtaatccatcttggacatagtactaaggtgattaaattaatcatgattgagtgttgagtgttaaaatccaaatgcaaatatccttcaaccaactttttgcaccaaaactaagtagactttatcatctcaaaatagtgcttactaaatatagtcactctttgtaactcttagttttaaaaaccataataattgtttccctctgttttctctcctgagctgctactgctgctgttgctgctaaaatataaggtataccatgtatcacttttgcagaagacagctttgtttttgtaaagtgcctggaatggagtttgtgggtatattgattgcaggcactgaaagacctagatgaatatgtaagaatgaccacaagccaccagatgtgggtgtatttatccgtttgcctcattactaaaaggttttagttccaaaaaatatccagaagaatttagttttggggaactagagaggcagggggagtggaattaaattttttgaatttttaaacaagtaatttgagcttccaattgatatattgtaatttctttgcattggaatactgatttcttaaggagtagttgcagaaagattttctttagaaattagaaattgacagccaggtgtggtggctcatgcctgtaatcccagcacttcgggaggccaagaccagtggatcacaaggtcaggagatcgagaccatcctggctaacacggtggaaccctgtctcttctaaaaatacaaaaaattagccgggcatggtggtgggcgcctgtagtcccagctacttgggaggctgaggcaggagaatggcgggaacagggaggcggagcttgcagtgagctgagactgcgccactgcactccagcctgggcaacagagcgagactctgtctcaaaaaaaaaaaaaaaaaaaaaaggaaattagaaattgactttgaaattcatttattatgtaaacaggaagatattttattgcaaagacaattggaaattggaaagtgtaattagttattaaaacagcaattaagacattttgtgggcttagatatatgtgtgtgtttgccttggtggcatgtgctctgctccatttgcacattaaattatgcccatatagttatatctggtattctgctccttaaataagtcatttagtttcattgatagagggtaaatgaagttctttttcattcttttcagagatagcatagggtagtggtaaggatatttcgttttggagtcagtctgcttggattaaaatccaaggtcacctccattaagctttgtaaccttgggcaagttagtaaatctgtgtctcagtttctttatctgaaaaatggagataatactgttacttatttcactgggttcttatgatgattaagatgaaaaattatgtaaagatctggcatataataagagatcaaaatagaaattttaaaacatttaaattatatatatagtagtatttgccttttttggtttacagttctgagttttaatacatgcaaagcttattgtaaccaacaaaacatcaacacaataggatacagaaaaatttccacactccccaaaattctttttgcctctttatcttcagacatatcacctcccttccattccaccaaatcctcgctacaactgatgtattttctgttcctatagttttgcttcttgagactgccatagaaatggaatcataccatatgtaatcttttgagacctagtataatgtctttgaagtacaacctgattttcttaggctcttatctgaagagctgatttcaccacggaaaaggaattagaggaggtgtttatttttatttttaatttttgatcaaggggaagaaaaataaaactcagattaatatcatccaaaaggagagtttggatttgtatgagaattatttttcagcatttcaaactatcaaataggatgtatcttcaagaggaaattactttcttgtcattaagtacaatgaaatataagctaaagagccacttggaatgcgaaatgcagaaaaattctagagagtcaaatataaattaaatgatatatatttgattctagaaagtcaaatataaattaagtgttgatgatggtggtgtgtggtgtgtgtgtgctgcgggtggagtgggggcaaagtgttggaaggtcaccaataatcccaaataacccataaacataaccagagtagcttagtatcatctgggggcaagttagctactgttgggggtcttggagaagacttagaccctaatcatctcccaatgcactacatgagtagggaggttaagaagcagctattatgaaagggggaagagagaccatgtcttcaccaggaccgggagaatgatggcatgggagagggtgagaagtgaagtaagggaaggagctgagcgggtggctgcctagataaagctgcaactggggaggagttgtatgtcaaaacaaaaacactgcatatttgatccttaataaggaaataatttttatgatttttaccgcatagtttcctaatttatttgtgtgtatatacatgtatactaaaatgtgatattagatgtatagatgtgtttttaactcaacccatcttaaatttgcaaatcagttaacttgctcctgaaaaatttagagtttaccgtatcagccacgattttctaggcatgtactagggtaatgtatatgctatttgattttttcttatttttaaaaaaatttcaatagttttgggggtactggtggtttttggttacatggataaattctttagtggtaaattctgagattttagtgtacgctgtacccaatatgcagtcttttatccctcattcctctaccaacctcttcccctacccgccaaatccccaaagtccattatatctctctgcatgtctttacattctcatagcttagctcctgcttataagtgagaacatggccgggcgcggtggctcatgcctgtaatccctcactttgggaggctgaggcggacagatcacgaggtcaggggatcgagaccatcctggctaacactgtgaaaccccgtctctactaaaaatacaaaaaattagccgggcgtggtggcgggcacttgtagtcccagctactcaggaggctgaggcaggagaatggcctgaacccgggaggcggagcttgcagtgagccgagatgccaccactgcactccagcctgggcaacagagcgagactccatctcaagaaaaaaaaaaaagtgagaacacacggtatttggtttttcatttctgagttacttcacttagaataatggcctccggttccatccaagttgctgcaaaacactttattttgtttttttttttttttatggctgagtagtattccttggtgtgtatatatatcaaattttctttatccactagttggttgatgggcacctaggttggttaactatctttgcaattgcaaactgttatttacaagtattacaattgtaagtaacaatttgattgcaattataattattatttaatacttgagagaaaactcttcgggagaaattttttccatttcatagatgaggaaactgaggttctgagaagtgaaatgaggtacccagagacgtgcagatcataaaagcaggcagagacagaatttgttctcagaaatgtctgttcatcttctgagcctacgctcttctctttgctgggcttttgctattttctctgcttttacatggtggtgagaatgtagggttttgagtcttctttctattttaaaatctatgatccaatttaaaatgatggaaaacagtgtctcaaattttaaagtataatctataatgatactttctccttgtgtcttttattgttactgactgaacttagcaaggaatttaggaaaaaggtaaagctatggaaaaatcttagaattagaaggcctgagtcaaaatttcagttctgctcattatagctgcttggcctttctcagcttgtgttctctggtaaatttgaaatgataatatttgttaatattatgagttattatgtggtttaaatgagaaaaattataggcaaatgtgtagctatgcttatcacatggtagatatttaatggagtttgagaaattagaagaaaatataattaagaagcatgtttcaagacttaagtataagaaaaaagggtgtggctttatttatttatttagactagttaatttggggttctggtttgtgctcggtggttttagaggaggacgcacaggatatttttttttaagcataaaggtaacgaaagatgtgtctgtaggcaaatctatagatatgattacataaaacatttacttctgaatatttataacataataaacaaatgtagttttagaggaggaggatgcacatgtcagtatttcatttaccttcaattccgtctcatgcgtataagtatgaatctagttagatcaacagggaatacactggataaattaaatttaagtatgagatgtataaagaattgtttttgtccatgatagttttcaccaaaataatatgctttttactctattcccatcttaattcctctcaatttaagatgaatacatttctctgagattttcttacaaaaagtaaagaaagccaagttaggttcagacattatttgtattttctttatttagcacttgttcttttttcttaaaccacttctttctgatctgaggaaaatgcaaatgtgagcagtcagggaattcatgattcgttagaatttaactgtaacataatttgtgggctgtggctgcattactccattttgagactgatatcttcccccccccctttttttttttttttgctatgctcttgaaattcagtaccactcatcaaaaatacttattgaaagtttgtttccagcaactcacatgctgggacttgttgacaagaggaataaagcctagcacaccaagtgaggacatagaaattttggaaaccatcaaggagtcagtgcctggtcaggtaggaaagaagagaagccagcatgggtaaaaatgaggattgatgattatgaaagcaggatgctcagctgtaggtagctgcaaaattgttaaagcaggaggagggagggcaacacttcaaattactgctggaagcttggctgcttccccagagcatagccatttcattaatcctggcagccctagtgtgtgatccttccactttttaaaaggcacagatcacagcttaagataccatatgtcagcaatctacagatttgttggaattaacagagaagagagtttatgcaaagttcacttgttgaatgtgcttttaaggatgactgtaagcatgatatttgccctatttgtttatgactatggtgaggatttttatgtcttctgctcacgattcctcattatacaagtgactcagaggtggtcattgatgaaaggcacagagtaataatgttaggttttactctattccttgcttcagtcaaattgatcacctagaattgaagttaattgcaaaaacgtttaatgcagagtgctcaaaagctaaaaagatctttcgtgtgtttcttaagcccctttggtgtatttgacaggttacataatacccatttttttctaaaagctggcatctttactccggaaattactgaaaaagacatggcaaacattttcagcgctttcccagtgaatatgaatttatttttaatttttcccacagttatcagacattatcaacatttctgttttttaaaaattaaaaatacactgctttataccttacaagaattcctcagcaacctctcacctacatttgtaccttacaggaaactcatgatatagatattattttctccattttgtggtggagaagacagaatcagagaagttaagtactttttctaagaacacagagtcagtaaagaaataaaaccagcttttgaatctttgtacacttaccccagaatctctcctctctctcctagagcatacagcttttgtatagatgctgacaaaatatggggtgatatagatgatgttcatggaaatgaatttattgtctttgcaataatagtctcttgcccttaccttttatctctcattttttcccagttcatttaacaagtctattcaccagttacaaaatcatagtaatgtggtacaggcacaacattcaacagtaagaggaagtcatgttatcaggaaggtaagaaacatgccagagtatatatatagagatctattaggtcaggtgatatcttaaatcagtaagaaaaagaaaaaaatgattggcttactatttagaaaataataaactaagatcccaactgatcccataagccatacaacaaaatgaattccagatggataaaaagtgtaaaagtaaaaagtaagtcattaaaaaaatcctataagaacataaatatttagctcatctcaggagatggcaggattttttaagcataaatgtaacaaagggaggttctgcctatagacaaatctatagatatgatcacataaaacatttaattctgtatatttataataaacaaaataaaaatcaagcgcaaatgggaaactatttggcatcagataaaagattgttatttttaaaatatcaaaagcccttacaaatcaaagacaaaaaaatataataccaagactacaattaaaacatgggtaaaaaatataatcagacaatttaatgcagaagacatacaaatggctttttattaaaatatttaaacccattttgtaaagaaaacattaattacaataagctgtactttataaaaatagaatggatgtttcaagatacatatatctaattttggtcatggtatagtgaaatggacgcatatatattggtgggactataattttgtgcaaactttctggaatgtatttttaaaatagtttttaagaacctcaaagaggccgggagctgtggctcatgactgtaattccagcactttgggaggcagaggtgggtggattgcttgagcccaggagtttgagaccagccagggcaacatagtgaaaccctgtctctacaaaaaatacaaaaattagctggatgtagaggtatgtgcctgtactccagactacgtggaaggctgaggtcagaggatctgttgagcctggcggcaggccgaggctgcagttagctgtgatggcaccgctgtactccagcctggaaaaaagagggagaatctgtctcaaaaaaaaaaaaaaaaaaaaaattccacccccaaaaaccacaaaaccccaaaacaaaaaaataaaaacctcaaagaacttcatgtctttgacttataatgctccttccttaaatatactctatgattttagttgaaatttcaaacaaacaacaacaaaatataaatatataatgtacatatatttgtattttgatattttaaaaaagctttttattattgacattttccatcaacataaaagtagaaagagtattataataaatctctatgtactcactacccagttttgaaaattgttaatatttttctagtcttattttatctattttattctctctctctacaggattaccttaaagcaaatccaaagcttcttattattttatttgtaagctctctgtataataaaagctttaaaaagtaaccaaaggctattattaagtttaagagaattgaacaagtttaggctcaaatttctcaattgtctcaagaatgtcttttttacaactgttttgttcacattagaatccaaacaaggtctacatattgcatgtggtattcatatggcctcttaagtttctttcaatgtataacagtttccccttccctctttctcctgttacttatttgataaataaattaagtattttgtcctgtagaatgtctcgcattctagatctagttgatggctactttatggtatcatttgtttttttcctcctgtatcactcttattttccatcagctagtatttaaagtggaaggattgattagagtcaggctcatttctatttttattttttggcaagaatactttatatctgagattctgtactcctgttgtacgacaccagaaggcatgtaacttctggttactccacttttagtgatgttaagatttattagtaggttctggtgagtcctccattatcgaggtcctcactgaaattttacctaatggttataacattcattagtgactgtttcctagatctataatttcattaagatttataaaatggtatttttctaactctgttgattatttcacattaattagatagtaattttctgtaaagaaaatctttctctctccaacaattttttaccctaaaacagttcatgctgaaaaagcatgtatacacttgtttttcccctctatgaatcgattttcagaataatgagttggtgaccttgcaacctccatcttgttggtttatgatagagaaaactggttaataacataaatgtccaaaaatagaagatatattgtggtatgcccatgccggagagccatgttgtaaatattgtgcagtctttaagtttcaaagaatatttaataacacagaaaaatattcaggataaagtggaagtaaaaaaccccagaatatgtacatagtgtgattcaaatgttatctaaaatatatgcattgtagaatgctgtcttagcctcagacactaacatgattatcataggtttgtaagttttagggtcttccaacttgaatctttgttttctataggaccttttataaaatacatgatttttgtcattaaaagaaaatgtaaatttgtttaaaaggaaggtctctggatggatcatcatacatggagagattcatgggtgttgatctttgctcccgcttaatttttaatttttattataactttgaaccttatctcctacatctaaaccagtcttcatggtgctaaccgagcaactggatggattgaaaacatgctcaattctgtagattctgagacatctttttagttaaacagaactctttctgttgactcacataataagaatatggtcttattaagtcatactcatctcaatttgaccagttcagaaaacagataactgaattacctttgtgtctttgtgtgtgtgtgtgtgtgtgtgtgtgtgtgtgtgtgtattttatcagctgatccattgatccatatcagatgaagaaatgaaccacagtctcaagattcggtcttcctgctagggccagtttgcttgttgctgatgcaatgagtgaaaggaactttgcttgttgcttagttttatgatgaatgaagggaacaaacacactggtttttacttttataaattcccagtgatccccaagaaagtaactggatcctccaggaaatcccagtggcctagtttctatcagtgtaaaataaggatcagatgatatgactcatagggctgttgccagcagaatgtatgtaaaatttctgccacgatatttagcaatcaaaaagtttgcaacaaatgcttgttttctcttctctcttcccaaaaataaaaggaagctgtcttttccatttttactatattctaatgttagagagccaattctggcatcagactgcctagattcaaatccagctctactcttggatttgggcaagtgatataagtaaactctttgtgactcagcttttaaatctgaaaattgggatactaatagtgcctacttatagactgttatgcatattaaatgagttagtgaatgtatagtattaaaactttttcctggcataaaataggaactataagagtataaactattatcttttttatctgcctagtggaaaaacatttccaagctcaaggttcaaggcaccccctccttggatgatgtaggagatgtactctgaccacttcttgttttttacttctctttttctgggtcctatataaaccttcttctttctgttgatgtatttaattcttatagccacaaatttagattttgataaattagataaatgttttctcctgcattattaagtgattaggattatgtgaagtttgtccccttttcttgttgtcgttgtagtggtcatgtgtgtgcctaagtgtctgtgggtgcctgcatgtgtgagttgaggtcctgaaatatggtattacagtctccctgataacttaggtgcagttgcaactttccagacatttattttctgactaatctttctttttggttaatttctacagatttttgcttctgtcatgtgaaattttactagtatattgctcaaaaggtaaacatggcactgttcctggtaatgggtgggaatgggatgacctaacctcttccaaatgtgtttacaatagaaggattattagatgagtttaggagaggctgctggatggctcagagatagggacaatccacatggattcaaggaaaataatgcttagttagtatatgaggagcatgaggtcctaatggaagcattactttccaaatatagggactgtatcagaaaacgtttcctgctcacagtgaaataaataaatagatcaaaagtggatataatataccctctagggcagtaagttaaaatgataccataaagtaaattttcaaaatgtgctgctgatgagaccaagatggccatcctaattagtcataggcaccaaggtgtttctcaagttcccccaaagtgatcagggtgtgtgccttagaaaaacagaacagtcatagtttaacactcatatgataatgtcatgtggttgaaacagatccagttatagaaatggagtctggaaaagtgaatgccgataaataaagccttttcatcaggcagccagaagttctcagaattcaaggtaatttgattctgaggacaggccccagttgactgcatagaaataactatctaggaaaaggacaattcattcagatactctactctatggaaacgattgattaagagcatgcatgtccagctgttttaattctgtgctcacaagggcacagactgaggtgctgtttgttctactgattgttcatacccagcaggagaaagtcatttgtgcaaatgtctgttgatagtggtactgttagttgaactttctatctggggcagatcacacagggcctagttaggccacagtagcgatttggagggttgggaagccatttgtgtatttcaaaggaggaagtgagagaaaaatgtggtgctatttatagatgtataaaatgtgaaattggaaacatcatctgcttgaactattttaaatttaaaaaagagtcatttgtttttcattcaccaaaactttggaaaccctaaaatagtgtgtgaatatacatgaattggcttatgtgattgaagcctggaaattcagataacagttgatattgtagtattgagcctgaattccacagggcaagaggctggagactcagccagggtttttgtgttgcaatcttaaggtgaatttctccctgttcaggaaacctcagtctgtgctgttacagcctcccactgattggatgaggcccacccacattatggaaggcaacctgctttactcaaagtctactaattaaatgttaattgtatctaaaaaatagcatcacagcaacatctagcctggtgtttgacaaaacacttggcaccgtcaactagccagattgacacagaaaattaaccattccagataataaagaatttatgatatcaccctcagtttagaggtgactttgttagccaggaaaggcaattgactgtttttgttttaggcctgcaatcagtaagagagaggaccgctcttcttatcagcttcacacttggaaggggaggcataagatagctagagcactttatagccccttggaagtctaaggtgataagcatgattatttgaacacaaccctttttgtcctattatcacgcaacctttttattgtgtgataagtcagtgataagggctgatgtcccctaacttcattattgacattaaagaaacttactaattgatgtttttattaatttgctaattaaaaaatgaatgccttcattgctagtgaacaatcttttcttcttagaaggcaatatttacaaaacccatatgaccatgtttaaagaagatgaaaaagaatattggaatgaattttggaaggtcgttaacaattttgtttgaggacagaaaagggagcgtttccttcttactttctagttttagaagtctttccctgtacattgtggagtcatggtgataaatataccatggttggtgataaatataccatggttggtgataaatataccaaacaacagagaaacctaatatatatacagccccaagcttattaaatatcacctaagattgacaagaaaaaaactagtttcttagaaaaaaatggtatttatttacttattacttttttttttcttttaaagagacaagatcttgttctattgtctgggctggagtatagtgaaatgatcatagctcactgtagcctccaactccttggctcaaatgatcctctcacctcaccctcctgagttgctgggactacagctgtgtgccatcatatccagctatattttttattttttgtaaaggtggagtctcactatgttgcccaggctgggcttgaactcctgggctcaagcgatcctcccacctcagccttccaagtagctgggactacaagtgtttgccaccatgcccagctaaattttaaaatttgtttggaggtggggtcttgttatgttgccccagctggctcattatttaattataagacagttaaaggtcactttgtgatgcattatttgaaacaaaaataatcataacgatttctaatgattttccataaattttaatttaaactctgactcaaattcattcagatcaagtttcaataaaataaatagcatcaagagcaaatggtgtattatcaattgatagtgtccagtgctaataaacatgagtttgagtctgacatgagccatttggtttcaaggcctatgctttaggttacattccaaggttttagcctatgtttccacccctctgaaatatatccttagccactaagggaacgtagcaagaggttatgggtaaatgaatatgtgcaaatgctcctgtgagaaaacaactcagacttacaggcagttgagatgtagtggtgggtaaattatgtcattgctatgtcatggatgaatatgaagaggtagcatcatcctttctgtcattaaaaaaatgacattttaactttcttttgaaatcagctagcaagtaatgcatttatgttgtgtgtatcaaagtatacaataaatgttgctactattgtttattagatgtttaaaatcatttttctctctcatctatattacttacaaattgttgagactgaaaactgaacttctaactaattctattcattatctcatcttgaacattactcatccatatgcaggatttgtgtaaatgaatgttttttctttgtttatgggacctaacttaaataatggttccattgtgacactcttgtgcagtgaaatggaagtttctgtgggtctaagatttgctgagggcctcccataggccaggcactgatgtagaaatatttaggtcaggcacggtggctgatgcctgtaatcccagcactttgggaggccgaggcaggtggatcactgaggtcaggaattagagaccagcctggtcaacatggtgaaaccctgtctctactaaaaatataagaaagtagctgggcgtggtggcacatgcctgtaatcccagccactcgggaggctgaagcaggagaaccgtttgaacccgggaggcagaggttgcagtgagccgagatcacgccactgcactccagcctgggcgacaaagtgagacttcatctcaaaaataaaaaataataaaaaaagaaatatttaaagcagtcctctgccctctaggagtttacagtctcatgggggacccaggaaaaggaacacttgtagtatattttaaacaatgatataaaagggttttgcacagaattatgcttcctcttctagcttttcttgcaccacccacaaatgctttgtcataggccctattatttttgcctgctcagcgttccttgcatcttctctaccaggaccccaattttcctttgtgaatcatacctttccaattatgatctgtcatttgaagtataccaggctgtcattcaaggttgactgtattcctttaaccaagggacagatatttgacccaagagaggctaacctacatctcttccaccaacttgagtcttagtcagtgacttaagaagtgagagtggttggaggcttaattcccatggtcacatcctaaagagattatccaacctgccttgacaaccggtacttcctagtcctgcatgaaacctagttgttaaagtttactttgattttgtgaacaagctacttcatcccatatctttccataaattccttaaaaattttagtttacattattttaaaacaaagaatccctgatatgatcggagattcaatagcaaagctctctctaattctcctttttccgcctataccttcatcctgtcctcatgaaaattgcattcatttttcttccattgtctacattttgcctctagagtatagcgattgccatttgaggaagattcttggcccaattgaggcagatttggatttactcttatattaatcttattgggtgggaattagaatgattatttttgagagtcaattgtacatattctatctcatttaactattacaataaatctatggataattatctcaattttatagttaaggaaacagtagttcagataggttaaggaaatggttcaagtttatctaccaggaatgtgtcagaggcttaatttgaacacacatctatctgacttcaaaactcagacttttcttggggattccctgccatctgacatcacaactttgttattttgaagacatcacttcccttacctctgtgaatcttagtttcattgtccataaaatgggagtatgaatacctatgacatatagttgatgattaaattggaaaatatacagacagcccttaacctttgtaggtggtcaaaaatgtggatgctttctacttcacatgttaccatatttgatttataagactggtgaattctttcgaattacggtgaatttaaaatcttgattgaactagtcatttctagttatagcatactttagcaaaattttcaccagaacatctagcagccaaaaaacattaaattccattatggtctcctcattccctctatccctataccttcccaactactgggaaaaatgctaacaaacaataaaacatctgtagtagaacgtcaatgacaaaggccattcataaattcaaactcttagtaagtggaaattgctctttgcatatttgcccctgggattacatatttgcttattgtgtttcacatgtcatttgtcagcttaaaaaatttaactcatttttataatattttagaatttatatatattcagacattcttatatatatgtgtgtggtatatatatgtgtgtatatttatgtgtgtgtgtatatatatgtgtgtatgtgtgtgtgtgtgtgtgtatatgtatatatatagtcctataagtttagagggaattttcagtatagcagtggaaataatagcagttctttctcacagtgttgttgtgaggcataaataaataatatatgataatagtgcttagtgcagagtaagtgctcagtaattgctagctatgattattaggacagttatatttccagcattttgaacataattgatgcctagcaattttttgttgaatagttaacagtcacaagaaaaggtttcatgagataggttagtagttgaaaacaaaatattttacattttacaatgtttaaatgcaaagtgtggaagagaagtagaattcaatttaaaggttttgtttcttttaaatctagcaaacttttctggtgtgagatgtgattattattgactcaaatgaagctttcggttttagcttcaggtgtgagttttgctcattttccttgctgccaggaagtaatgcctgtactgatagtttgagagggaagtcatacttttgaaatgcaccacattctaaaggtagttcattatcctcacaactgtaaatgaaacccacatccttttcttctggccaaggtaatggtaaaaacaccgcagaaaatacattttgtaagcatgtattttatacactttggtcaaagggacattgttgtgagaatcacatgtttagagtgggtggatgaggcagaagaactacagctttagtagcatcagataccaatgtggagctctatctatttgtgaatggggagtctgaggagggggtagagtaggaaggctagaaaggctggggaaggagagatgtgaggaattcaatggaaccaaggttaaggcagtaggaataactgaaagcatgataaatcatggtctattggagtaaatctaaggtttacacatcagggaaagaacttataaacaacacttgtggtgatactggcaaggatactggagactgggtcagagttaagagttcagagctgagtaaagaacatgaggatgtgacagcacacacctgatggcctaactctctttatgtgtgcagatcatgcatggcaagtccactgctaaagcagaccaagcagcttaatactctgaggcaggacacattaattcctgaggcaagtcttgctatatgtaagcagaagactcatatcagtttggaaggcatgagaaattctcataaacaagaggcttcatcttctataataagatatttatgtactactgtctactcaaatatatagcagaataagagaccaaaattgaaattaaacaagagaagtatcatcgtatcccatcataattgtcttctccacctctgtccccaactatgatgaggaacatgttacaggatgtatcaatggtaggagcaatattttagatggcaagtttttgtagattgatgttgacacaagttatacaaataattgatttctgcatttacaactgaggtatgggttcatctcactggggcttgtcaaacagtgggtgcaggacagtgggtgcagtgcaccgagtgtgagccgaagcagggtgaggcatcgcctcaccagggaagcacaaggggtcagggaattccctttcctagccaagcaaagctgtgacagatggcacctggaaaattgggtcactcccaccctaatactgtgcttttccagtggtcttagcaaacggcacaccaggagattatatcctgcgtgtagcttggagggtcccacgcccatggagcttcactcattgctagcacagcagtctgagatcgaactgcaaggtggcagtgaggctaggggaggggcgcccgccattgctgaggcttgagtaggtaaacaaagcagccaggaagcttgaactgggggaagcccaccgcagctcaaggaggcctgcctgcctctgtagagtccacctctgggggcagggcatagccaaacaaaaggcagcagaaacctctgcagacttaaatgtccctgtctgacagctttgaagagagtagtggttctcccagcatgcagctggagatctgagaaaggacagactgcctcctcatgtgggtccctgaccccgagttgcctaactgggaggcaccccccagtaggggcagactgacacctcacacggccgggtacccctctgagatggaacttccggagaaatgaccaggcagcaacatttgctgttcagcaatattcgctgttctgcagcctccgctgctgatacccaggcaaacagggtctggagtggacctccagcaaactccaacagacctgcagctgagggtcctgactgttagaaggaaaactaacaaacagaaaggacatccacaccaaaaccccatctgtacgtcaccatcatcaaagaccaaaggtaggtaaaaccacaaagatggggaaaaaacagagcagaaaagctgaaaattctccaaatcagagcgcctctccccctccaaaggaacgtagctcctcaccagcaatggaacaaagctggatggagaatgactttgacaagttgagagaagtaggcttcagataatcaaacttctccgagctaaaggaggaagttcaaacccattgcaaagaagctaaaaatcttgaaaaaagattagacgaatgactaactagaataaccagtgtagagaagtccttaaaggacctgatggagctgaaaaccatggcacgagaaatatgtgacgaatgcacaagcttcagtagctgattcaatcaactggaagaaagggtatcagtgattgaagatcaaatgaatgaaatgaagcgagaagagaagtttagagaaaacagagtaaaaagaaacgaacaaagcctccaagaaatatggaactatgtgaaaagaccaaatctacaactgattggtgtacctgaaagtgatagggagaatggaaccaagtcggaaaacactctgcaggatattatccaggagaacttccccaacctagcaaggcaggccaacattcaaattcaggaaatacagagaatgccataaagatactccttgagaagagcaactccaagacacataattgtcagattcaccaaagttgaaatgaaggaaaaaatgttaagggcagccagagagaaaggttgggttacccacaaaggggagcccatcagactaacagcacatctctcagcagaaactctacaagccagaagagagtgggggccaatattcaacattcttaaagaaaacaattttcaacccagaatttcatatccagccaaactaaggttcgtaagtgaaggagaaataaaatcctttacaggcaagcaaatgctgagagattttgtcaccaccagacctgccctacaagagctcctaaaggaagcactaaacatggaaaggaacaaccggtaccagccactgcaaaaacatgccaaattgtaaagaccttcaatgctaggaaggaactgcatcaactaatgagcaaaataaccagctaacatcataatgacaggatcaaattcacacataacaatattaactttaaatgtaaatgggctaaatgctccaattaaaagacacagactggcaaattcgatagagtcaagaccagtcagtgtgctgtattcaggagacacatcacacatgcagagacacacataggctcaaaataaagggatggaggaagatctaccaggcaaatggaaaacaaaaaaaggcaggggttgcaatcttagtctctcataaaacagagtttaaaccaacaaagatccaaagagacaaagaaggccattacataatggtaaagggatcaattcaacaagaagagctaactatcctaaatctatatgcacccaatacaggagcacccagattcataaagcaagtccttagagacctacaaagagacttagactcccacacaataataatgggagactttaacaccccattgtcaaatattagatcaacaaggcagaaagttaacaagatatccaggaattgaactcagctctgtaccatgcagacctaatagacatctacagaactatccactctaattcaacagaatatacgttcttctcagcaccagatcacacttattccaaaattgaccacatagttgggaagtaaagcaaatgtaaaagaacagaaattataacaaactctcagaccacagtgcaatcaaactagaactcaggattaagaaattcaactacatggaaactgaacaacctgctcctgaatgactactgggtacataacgaaatgaaggcagaaataaagatgttctttgaaaccaatgagaacaaagacacaacataccagaatctctgggacacattcaaagcagtgtgtagagggaaatttatagcactaaatgcccacaagagaaagcaggaaagatctaaaatggacaccctaacgtcacaattaaaagaactagagaagcaacagcaaacacattcaaaagctagcagaaggcaagaaataactaagatcagagcagaactgaaggagatagagacataaaaaacccttcaaaaaaatcaatgaatgcaggagctggttttttaaaaagatcaacaaaattgatagactgctagcaagactaataaagaagaaaagagagaagaataaaatagactcaataaaaaatgataaaggggatatcaccactgatcccacagaaatacaaactactatcagagaatactataaacacctctatgcaaataaactagaaaatctagaagaaatggataaattcctggacacataccccttaccaacactaaaccaggaagaagttgaatttctgaattgaccaataacaggctctgaaattgaggcaataattaatagcttaccaaccaaaaaaagtccaggaccagatggattcacagccgaattctaccagaggtacaaggaagagctggtaccattccttctgaaactattccaatcaatagaaaaagagggaatcctccctaactcattttatgaggccagaatcatccggataaccaaagcctggcagagacacaacaaaaaaagagaattttacaccaatatccctgatgaacatcgatgcaaaaatcctcaataaaatactggcaaaccgaatccagcagcacatcaaaaagctcatccaccataatcaagtgggcttcatccatgggatgcaaggctgattcaacatatgcaaatcaataaacataatccagcatataaacagaaccaaagacaaaaaccacatgattatctcaagagatgcagaaaaggcctttgacaaaattcaatagccctttatgctaaaaactctcaataaattaggtattgatgggatgtatctcaaaataataagagctatttatgacaaacccacagccaatatcatactgaatgggaaaaaactggaagcattccctttgaaacctggcatacgacaggaatgccctctctcaccactcctattcaacatagtgttggaagttctggacagggcaatcaggcaagagaaagaaagaaataaagggtattcaaataggaaaagaggaaatcaaattgtccctgtttgcagatgacatgattgtatatctggaaagtcccatcgtctcagcccaaaacctccttaagctgataagcaacttcagcaaagtctcaggacacaaaatcagtgtgcaaaaatcacaaacattcttatacaccaataacagtcacatagagagccaaatcatgagtgaaatcccattcacaattgcttcaaagagaataaaatacctaggaatccaacttataagggatgtgaaggacctcttcaaggagaactacaaaccactgctcaacgaaataaaagaggacacaaacaaatggaagaacactccatgctcatgggtaggaagaatcaatatcgtgaaaatggccatactgcccaaggtaatttatagattcaatgccatccccatcaagctaccaatgactttcctcacagatttggaaaaaactactttaaagttcatatggaaccaaaaaagagcctgcatcgccaagtcaatcctaagccaaaagaacaaagctggaggcatcatgctacctgacttcaaagtatgctacaaggctacagtcaccaaaacagcatggtactggtaccaaaacagacatatagatcaatggaacagaacagagtcctcagaaataatatcacacatctacatccatctgatctttgacaaacctgacaaaaacaagaaatggggaaaggattccctatttaataaatggtgctgggaaaactggctagccatatgtagaaagctgaaactggatcccttccttacacctttacaaaaattaattcaagatggattaaagacttaaatgttagacctaaaaccataaaaaccctggaagaaaacctaggcaataccattcaggacataggcacgggcaaggattccatgtctaaaacaccaaaagcaacggcaacaaaagccaaaattgacaaatgggatctcattaaactaaagagcttctgcatagcaaaagaaactactatcagagtgaacaggcaatctatggaatgggggaaaatttttgctatctactcatctgacaaagggctaatatccagaatctacaatgaactcaaacgaatttacaagataaaaacaaacaaccccatcaaaaagtgggtgaaggatatgaacagacacttctcagaagaagacatttatgcagccaaaagacacatgaaaaaatgttcatcatcactggccatcagagaaatgcaaatcaaaattacaatgagataccatctcacaccagttagaatggcaatcattaaaaactcaggaaacaacaggtgctggagaggatgtggagaaataggaacacttttacactgttggtgggactgtaaactagttcaaccattgtggaagacagtgtggcgattcctcaaagatctagaactagaaataccatttgacccagccatcccattactgggtctatacccaaaggattataaatcatgctgctttaaagacacatgcacacgttatgtttattgcggcactattcccaatagcaaagacttggaaccaacccaaatgtccatcaatgatagagtggattaagaaaatgtggcacatatacagcatggaatactatgcagccataaaaaaggatgagttcatgtcctttgtagggccatgaatgaagctggaaaccatcattctcagcaaactattgcaaggacaaaaaaccaaacactgcatgttctcactcataggtaggaactgaacaatgagaacacttggacacaggaaggggaacatcacattccggggcctgttgtggggtgggttgagcggggagggatagcattaggagatatacctaatgtaaatgatgagttaatgggtgcagcacaccaacatggcatatgtatacatatgtaacagacctgcacgttgtgcacatgtaccctagaacttaaagtataataaaaaaaattttttgttcccatttatcactgatggatgcattgacttgtttaacaagaacaaagtgcttcctttaaaatgtgataaaaagcattaaaatttgttgagatttttaaaaatcttgattttaatcacagctgttaacctatttctagaattcatgtagtcacatctaatgttaataaaaaaggaagagaatgtgtgcggggtccagaggaagggagataactcaaaagccagtgatattttgcagtttaacaatatgagtagtgagaaaaattttcctccctttgaagatataattctgtctgaattctttagaacaatgtttttgtatttattaaatatatttattagtaaatactaaaattattcctttgacattttaaaaattttattgtgaaaatctaacatgtaccaaaaatatgttagatttttcagaaaaaaatctgtacatttagattaggttatagagaaaaattataaatttagatttatagattatagttaaatttatagttatattatagagaaaaaatatgttaaattatcatggacattctcaatcagctgcaagaattatcagcattttgacaatcttatttcatttagtttcccactttttttttgaagtatttaggcagactctaaacactgcataatttcacccataaatacttcactgtgcatttctaactgaaagaacatattttatgtatgaactgttatcaccataacttacaaaattaacaatattttaatctaatctaatatttaatccatatttaaatttactggatcgtctcacatatttttaaccatatatcccatttattagaattaagcaaagtcaatgtgaatgattggaaatcataaaagacatttgaagaaacatttatactaatggtaatatgatgaaaatgataatgaggataatgataggcttgtgattattgtagcaaaaataattattgtccttggtattaagctgcaaaaatctttggtcttaaattacattctttagaaagtcaatttaaaagttttagctttttagtttttagtaaaactttgatttcctaaaaaaaatctaagaatcttgggaaataaatcataatttcatcacccagtggtaagcactcaacatcctgggatatttcccacagtcttctttgtggatatatacatatgatatatgcaagtgtgtgtaatgtgcataaaactaggatttccgaggaggccaagatgccggacctagaagcagctgtggtccatggcactcacagagaggaatgaaaggggtgaaaaaatataccaccttcaactgaaatatccaagtacttgcattgggactgactagagaaacaactcgaccccatgaaaaaagcagggcagggtgacagcccacccaggagtgacacggagccaagggaacccccactcccagccaagggaagcagtgagtgaatgtgtgatcccaggtaaccatgcttctcccatggatctttgcaactcgtggttcaggagatccccgcctgagcccatgccactagggccttgattccaacagacagagctgtatggagtctcagcagagcagctgctcaggtatgcacagagacccaggagctttacatactccggccccaggatccccagcaaaggtgtctgcaactcagacaaggcaggatgtctgtacataaccctaggaagggggctgaacccagggagccaaatagcatcagcgtgcaggccccacttccatggcacctcacaaaataagacccactggcttggaattccagccagccactagcagcagggtagggcctgcctgagatgagaggcagcccctggaaagagaggcaggccactatctctgctgtttggttaactcagccattccagtctgcaggcttcggagagtccaaacttttcagacgaggaagggtccccccaacataacatagctgctttgccagaatgtggccagactgctattttaagtgggacccagatgcattcctcctcactgggcgggacctcccagctgaggcctccagctacccctgcccacatatattctacagacagagctctgatctctcaatgggacagagtgctgcccatggccctctccatggggaaagggccgccaccttggttgtttggacaactcagcctgcaggcttcagagagtccaagccaacagaggcaggggcagctcccgggaacaacaactgttttgtcaaggacagactgcgtccttaagtgggaccctgattcactcttcctccaggggaagatcctcttagagcctttggccacacctgctcgtgttgtatagcctgcagagttttaatttctccttgggttggaatgcttggggggcagggcacgccgccaccttggttgtttgtctgcttcagccagtccagcctgtgtgccttggtgagcccaaaccaactggtggctgaagggatccctaacaccacacagctgctctattaaaaagcagccagactgctgctttaagcagatccctgatctcgttcctcctgactgggtaagaccacccaactggggtcacaccagacacctcctacaggtgtgtttaggctggcaacatgtcagtaaccccctgggatggaactttcagaggaaggggcaggttggcatctttgctgttttgctgccttcactggtgatacctccaggtatgggaaaagctgaggcaattagggtcaggagtggaccctaagcaaactacagcagccctatagaaaagtggccagactgtcaaaagagaaacaaacaaaccacctccacctccaccactaccaccaccaccaccaacaccaacaagaacaacaataacaaacgacaaaaagcccatccaaaggtcagcaatctaaaagcttcagggtagataagcccataaagatgagaaagaatgagcacagaaatgctaaaatctcaaaaagccagagtgtccccttttcttcaaataactgtaacacctctccagcaagtgctcaggactgggctgaggctgagatggctggaatgacagaagtaggcttcagaatatgaataaaaagggacctcactgagctaaaggagtatgttgttactcaatgcaaagaaactaagaatcataataaaacaatgcaagaggtaacaaaaaaaagtaaccagtatggagaggaacataattgatctaatagagctgaaaaacatactataagaaccccacaatgcagtcacaagtattaatagcagaatagaccaagtggaggcaagaatctcagaatttgaagactacctttttaaaataagacaggcagacaagaagagagaaaaaataataaaaaggaataaacaaaacccccaagaaatatgggattgtgtaaagagaccaaatctacgaatcatcagggtacccgaaagagacagggagaatggagccaatttggaaaatatacttcaggatatcatccaggaaaacttgctcatcctagcaagacaggccaacattcaaattcagaaaattcagagaattccaataaaatactctatgagaagattatccacaagacacacaatcatccgattctccaaagttgaaatgaaagaaaattgttaagggccagaagagagaaaggccaggtcacttacaaagagaagcccatcagactaacagtgaacctctcagtgtaaatcctacaaaccagaagagtttgggggccaatgttaaacatttttaaagaaaagaaattccatcccagaattttatatctggccaaactaagcttcataagcaaaaaagaaataagatccttttcggacaagcaaatgccgagggaattagttaccaccagacctgccttacaagagttcctgaaggaagcactaaatatggaaaggaaaaaccattaccagcaagtacaaagacacactgaaatacacaaaccagtgacactatgaaaaaaacacacaaacaactctgcaaaataaggagctgtcatcattatgacaggatcaaatccacacataacaatactaactttaaatgtaaatgagcaacataggctcaaaaataaagaaatgaaggaaaatttaccaagcaaatggaaaacagaaaaaagcaggagttgcaatcctagtttctgacaaaacatattttaaacaaacagagtttaaaaaaaacacaaagaaggacattacataatgataaaggattgaattcaacaaaaatatctaactatgctaaatatatgtgcagccaacacaggagctcccagattcataaagcaagttcttagagatcttcaaagagacatagactcctgcacagtaatagtagaagactttaacatctcattgacaatattagacagatcatcatgagagaaaattaatgaagctattttagacctaaactctgctcaagatcaagtggaccttatagataccaacagaattcttcaaccaaaaatgagagaatatgcatttttctcaataccacacgatatttactgcaaaactgatcacataattggaagtaaaacactcctagcaagtgcaaaagaactgaaatcataccaaacaatatttcagaccacagtacaatcaaattagaactcaagattaagaaatttactcaaaaacaaacaactacatggacaacctgctcctgaattacttttgggtaaataattaaattaagccagaaatcaagaagttatttgaaagtaatgagaacaaagatacaatgtaccagaatctctgggacacagctaaggcaatgtaagagggaaatatatagcagtaaatgcccacatcaaaatgctagaaagatctcaagttacgaacctaacatcacaactaaaataactagagaaccgagagtaaacaaacccaaaagctagcagaagacaataaataaccatgatcagagctaaactgaaggaggtagagacatgaaaaacccttcacaaaatcagcaaatcgaggagctagtgttttgacaaaattaataaaatagactgctagctagactaataagaaaagagagaagattcaaataaacacaattggaaacaataagggagatatcaccactgacaccacaaaaatacaagcaccatcaaagaacactgtaaacacctctaataacataaactagaaaatctagaagaaatgtatcaattcctggacacgtataccctcccaagactgcatcaggaagcaactgaatccccgaaagaccaataatgagttctgaaattgaggcagtaataaatagtctaccaaccaaaaaaagcccaggaccagacagatttacagctgaattctacaagaggtacaaagaagccctggtaccatttctactgaaaatttctagaaaattgaaaaggagggactcctccctaactcagtctatgaggccagcatcatcctgataccaaaacctggcacagatataacaacaagaaaaaaactttaggccaatatccttgataaaatttgatacacaaatcctcaacaaaatactggcaaaccaaatccagcagagcatcaaaaagcttatccatcacaatcaagttggcttcatcctgggatgcaagcctggttcaacatacacaaatcaataaatgtgattcatcacataaacagaagtaaagacaaaaccacatagttatctcaatagatatagcaaagggcttcaataaaattcaacatccctacctgttaaaagctctcaataaactaggtattgaaggaacatacctcaaaatattaggaaccaaatatggaaaacccacagacaatatcaattttgccaatactgaatgagcaaaagctggaagcattactctgaaaattagcacaagacaaggttgccctctttcaccactcctattcaatacatcattagaagttctggccagggcaattatgcaagagaaataaataaaggtattcaaataggaagagagaaagtaaaactatctctgatttcagatgacatgattctatatatagaaaaccccatagtctcagccaaaaagttccttatgctgataagcaacttcagcaaagtctcaggatacaaaaccaatgtgaaaaaattgctagcattcctatacacaaacaacagtcaagctgagagcaaaattgtgaatgaactcccatttacaattgccacaaaagagtaaaatacctaggaatacagctaacaagggaagtgaagggcctcttcaaggaaaactacaaaccactgctcaaagaaatcagagatgacacaaacaaatgaaaaaccattccatgcttgtggataggaagaatcactatcgtgagcatggctatactgcccaaagcaatgtatagattcaatgctattcccattaaaatgccactgacattcttcatagaattagaaaaaaactctttaacaaattcatatggaaccaaaaaagagcccaaatagccaaagcaatcctaagcaaaaaataaataaataaataaataaataaataaataaataaatacataaagctagagtcatcacactaccttactttaaactgtattacagggctacagtaaccaaaacagcatggtactggtccaagaacagatacatagacaaaggaacataatagagaacccagaaataagactgtacacctataaccgtctgatctttgacaaagctgtcaaaaacaaacaatggggacaagatttcctgttcaacaaatggtgctgggataactggctagccatatacagatggtatactttcttataccatcaacaaaaatcaactgaagatggatggaatactcaaatgtaaaacccaaacctatcaaaaccctagaagaaaacgtagacaacaacaaacaggacataggaatgggcaaagagttcacgacaaagatgccaaaagcaaatgcaacaaaagcaaaaattgacaaatgagatctaattaaactaaaaggcttctgcacagcgaaagaaactatcaactgagtaaacagacaacctacagaatgggaggacatttttgcaatctatgaaactgacaaagtttaatattcagcacctataaagaacttaaacaaatttacaaggaaaaaagaaacaaccccattaaaaagtgggcaaaggacatgaacggacacttttcaaaagaagacacacatgtggccaacaaacatatgaaaaaagctcaacatcactaatcattaaagaaatgcaaatcaaaaccacaatgagatactatctcacacctgtcagaatggctattattaaaaagtcaagaagatgcttgtgacattctggagaaaaaaatgcttttacactgttggtgagagtataaattagttcaaccattgtggaagacagtctggcgattcctcaaagacctagaggcacaaataccaaataccatttgatccagcaatcccattactgagtatgtatgcaagggaatataaatcattctattctaaagatacatgcacacatatgttcattgcagctctattcacaatagcaaagacatggaatcaatctaaatgcccatctgtgatagactcaataaagagaatgtagtacatatatacatatacaccatggaatactatgccaccatataaaggaatgagatcatgtcatttttagggacatggatggagctggaggccattatccttagagaactaacagaggaacagaaataccaaatgccacgtgttctcacttataaatgggagctgaatgatgagaacacatagacacatcgggatgaacaacacacactgaggtgggaggagggagagcatcaggatgcagagctaatggatgctgggcttaatacctgggtgttgggatgatctgtgcagcaaaccacaataggacacatttacctatgtaacaaacatgcacatcctgcccatgtaacctggaacttaaaataaaaatttgaaataaaaaaaaactgcggcacatatcaacccatcatctaagttcaaagcccagcacacattagttaattttcctgatgccctccctccctatgcccacctccccaatcccagttgtgttgttcctctccctgggcttttgtgttcacattgtttcactcccacttataagtgagaacatgcagtgtttggtttttgttcctgtgttagtatgctgagtataatggcttccagctccatccatgttcctgcaaaggacatgatctcatttcttttgatggctgcatagtattccatggtgtatatgtaccacattttctttatccagtctatcactgatgggcgttttgtttgattccatgtttctgctattgtggatagtgctgcaatgaacatacacatgcatgtatctttataatagaatgatttatattccaaaaaaggatttctttgtaacccactcatttcaatttacaatttattttatgcattttccaagtcattggtgacagcgattaacgtattcacatatctttgtgttaatctatgattattcaatagcataattatctaaaatgggattcctatattagagtatacatacttttaagatttttagtatctatagcctgattatcccccagaaattttcttctaattccgtttccagaaaatgactacccattttaattcaactgcatgagtataaaatattaacatgttactttttgattaattgttgtatgaaatattacatgtttttattttctttaattttttgtgagaattaattcttttttgatgttttttaaaaaattcttttaaaaatgtttgtatcttgcccaggtgcagtggctcgcatctgtaatctcagcactttgggaggcctaggggtgcagatcacttgaggtcaggaattcaagaccagcctggccaatatgatgaaaccctgtctctattaaaaatacaaaaattagccaggcatgatggaatgcccctgtaatcccagctacttgggaggctgagacaggagaaccacttgaacccaggaggtggaggttgtagtgagccgagattgcaccactgcgctctagcctgggtgacagagtgcgactctgtctcaaaaaaaaaaaaagtaaattttctatctgtaatcataattgtttgcctatttattcataatgtttgcctagctttctattttaggactcattttatggatttgtaaagtctttgtctgtagtaaagatacaaatacagtatcttctgtcaattatttttccagccttttcttttaattttattttttcctgaagagtttttacagtggtttttattattattactttcaaagattatacttagaacgtccttctcatttaggccgggtgcggtggctcacacctgtaatcccagcactttgggaggccgaggcaggtggatcacgaggtcaggagatcaaaaccatcctggctaacatggtgaaacccagtctctactgaaaaatacaaaaaaaattagctgggcatggtggtgggcacctgtagtcccagctactcgggaggctgaggcaggaaaatggcatgaacccaggaggcagagcttgcagtgagccgagattgcgccactgcactccagcctgggcgacagagtgaaactccgtctcaaaaaaaaaaaaaaagaaagtccttctcattttaagacaataaacatatacttaaatttgcttcatgttgatttatgatttaaaaagtacttaaatttttattccttctggaaagatcgtatgaggggaggcactgaaaacattttccagttattttatttccatgttgtgtaatgaataatattttctttccctactattttttaatagcaactttattacatataaacgtttatgttcactttggcatataacactgcaatgatttgcacataaatgggttatgaagatagtacgaaaacatactctttcttcagtagattgttagaagatgccttgtgtagacttcttttgtatctcctatagtattttgaatgtggcagccaataaaaacttcttgtatgacatgaatgattaatgagtcatagatatgcctgggaaagtttttttttttgatttttaatttaactgttcttttaagttcaggggtaggttattatatagataaatgcaggtttgttatataaataaacttgtgccatgtgggtttgttgtacagattatttcatctcccaggtattaagccccatacccagtaattatttttcctgatcctctccctcctcacaatctccatcctctgagaggccccagtaggtgttgtttccctgtatgtgtccatgtgttctcatcattcagctcccacttataagtgagaacatgtggtattttgttttcttttcctgtattagttcactaaggataatgacctccagctccatccatgtccctggaaatgacatgatctcattcctttttatggctgcatagtatttcatggtgtatctgtgtcatattttctttatcaagtctaccattgatgggcatttagattgattcctgtcttttctattgtgaatagtgctgcagtgaacatatgcatacatgtgtctttataatagaatggtttatattcatttgggtatatacctagtaatgggataggtgagacaaatggtatttcagcctccaggtctttgaggaatcaccacattgtcttcctcaatggttgaactatttacattcccaccaactttgtataagtgtcctttttctctgcagccttaccagcgtctgttgttttttgactttttaatagccattctgactggtgtgagatgatatcttattgtgatttttatttgaatttttctaataatgagtgatgttgagttttttttcctatgattgttggcctcacgtatgtcttttgggaagtgtctgttcttgtcctttgcccactttttaatgaggttatttttttcttgtaaatttgtttaagttccttatagatgctggatattagacctttttcaggtatgtagtttgcaaaaatattctcccattctataggttgtttgttcactctgttgatggtttcttccttgtgtagaaactatttagcttaattagatcccatatgttaacttttgcttttgttgcaattgcttttagcatcttcgtatgaaatctttccccattcctatatcctgtttggtattgcctaggttttattctagggttttgattatttttgggttttgcattttaagtctgtaatccaacttgagttgatttttgtgtatgatataaggaaggggtctagttttaattttctgtatatggctagccagttatcccagcaccattattgaataggaaatcctttcccaattgcttgttttcgctaggtttattgaagattagatagttgtaggcttgcagtcttatttctgggttctctattatgttccttggtctctgcatctgttctagtaccagtatcatgctgctgttttggttactgtagccctgtagcatagttgaagccatgtagcatgatgtctccagttttgttttttttgcttaggactgccttagctatttgggctcttttttggttccatatgagttttaaaatagttttttttctaattctgtgaagaatgtcaatagcattttgatggtaatagcattgcatctataaatcgctttgggcagtatggccattttcacaatattgattctcttcacgagcaaggaatgtttttccatttgtttgtgtcatctttgatttctttgagcagtgttttttacttcttcttgtagaaatcattcacttctgtggttagctatactcctagatatttaattttttgttgttgcaattgtgaatgagattgcgttcctgatctggccctcagcatgactgttgttggtgtataggaatgtttgtgatttttgcattactaacatttttctatctcagaagacaaattgatttttgtatcctgagactttgttgaagtttatcaacttaaggagcttttgggttgaggttatggtgttttctagatataggattatattatctgcaaacagggacagtttgaattcctctgttcctatttcaatgcctttatctttttactttccctgattgccctgaccaggacttccaatgctatattaaatagaagtggtgagagagggcatccttttcttgtgctggttttcatgagggatacttccagcttttgcccacttagtgtgatgttggtcatggtttgtcatagatggctcttatcattttgaggtatgttccttcaatacctagtttattgagagttttaacatgaagaggtattgaattttattgaaagtcttttctgcatctattgagagaatcatgtggtttttgtctttagttctgtttatgtaatgagacaaatttattgatttgcatatgttgaatgaagcttgcacaccagagaaaaagtctacttggttgtagtggataagctttttgatgtgctgctgaattaggtttgctagtatattgctggggattttcacatcaatagtcatcatagacattggcttgacattttcttttttcattgtgtctctgctacattttggcatcaggaagatgctggcctcattgaacgagttagggaggagaccttcctcattaattctttggaatagtttcagtaggaatggtaccagctcttctttgtacaacaggtagaattcagctgtgtatctggcttttcccgagcttttgttggttggtaggctatttattactactcaatttcagagatcattatttgtctgttcaggaatttaatttctccttggttgagtctttggagggtgtatatgtcaagatatttatgcatttcttctagattttctagtttacatgcatatacatgttgataatattctctgatgattatttgtatttctgtggggtcaatggtaatatctcccttgttatttctgattgtgtttatttgaaccttctctcttttcttccatattagtctagctagtggtctattttattattattttttaaagttttgttgatgttttgaatagtttttcttgtttcagtctccttcagtttatccctaattttgtttttttttcttatcttcagctagatttgagattcttttagttgtgatattaggttgttaacttaaggtctttctaactttttgatgtagggatgtagcactataatttcccacttacactctcttagctatgtcccagttattctggtatgttttatctttgttctcattacttacaaagaacttcttcatttctgccttaatttcattatgtacccaacaggcattcaggagcatattatttaatttccatgtaattgtattgttttgagtgaatttcttagtcttgatttttaatttgattatgctatggtctgagagactttgtaaatgattttagtagtttgcatttgctcaggagtgttttatgtgcaattatgtgattgattttagagtctgtaccatgtgacaataagaaaaacttataatctattgtttttgggtggagagtactccagatgtgtatcaggtctatttgatctagtgctgagttcatgtcctgaatatttttgttaatttttttgtctggataatctatctaataatgtcagtacagtgttaaagtctcttactattattatgtgggagtatatgtctctttgtcaatggggttctctgcatttcctgaatttgaatgttggcctctctagcaaggttggagaaattatgtataatgtcctgaaatattctttccatgattcgttcctgatatagtttggttgtgtccccacccaaatctcaccttgaattgtaataattcccatgtgtcaagggtggggccaggtggaggaaattgcattaggggggcagtttccctcctattgttctcatggtagtaaataagtctcataagatctgatggttttataaaagggaattcccctgtacaccctctgttgcctgccaccatttaagacaagctttcgcttctcctttgccttctgccatgactgtgaggcctccccagccatgtggaactgtgagtctatttagcctctttttctctataaattcctctgtctgaagtatgtcttatacagcatgagaactgactaatacagtaaatcggtactggtagagtggggtgctgctgtaaagatacccaaaaatgtggaaatgactttggaactgagaaacaggcagaggttgggtcagtttggagggctcagaagaggacaggaagaagtttgaagggaaagtttggatcttcctagagacttgatgaatggctttgaccaaaatgctgacattgatacatggacaataaagttcaggttgaggtggtctcacatggagatgaagaccttgttggaaactggaataaaagtgactcttgctatgttttagcaaagagactggcattttgcccctgccttagagatttgtggaactttgaacttgagagaaatgatttagggtatctggtagaagaattttctaagcagcaaagcattcaagaggtgacttcggtgctgttaaatgcattgagttttatgtattcgcagatttatgctttggaactgaaacatgtttaaaagggaagcagagcacgaaaattcagaaaatgtacagcctgatgatgcaatagaaaagaaaaacccggttgctgaggataaattcaagctggcttcagaagtttgcataagtaatgagaagccaaatgttaatcaccaagacaatagggaaaatgtctctagggcctgccagaggtcttccagaagcccctcccatcacaggcctggaggcctaggagaaaaaagtggtcttgtgggctgggcccaggaccttgctacattgtgcattctcatgacttggtgccctgtgccctagccatggctagaactcaggccattgattcagaaagggtgcatgacccaagccttggtggccttcatttggtattgggctgtgggcgcacagaagtcaagaactgagatttgggaacctccacgtagatttcagaggatgtatggacctggaacacacaggttccagaggcagtatggaaacgtctggatgaacaggcagaagtttgctgcaggggttgggccctcatggagaacctctgctaggacagtgtggaagggaaatgtggagctggcacccctacacagattccccactgggacactgcctagtggagttgtgagaaaagggccaccgtcctccagaccccagaacggtagatccaccaacaccttacaccacgtacctggaaaagccacagacactcaatgccagcctgtgaaagcagctgagaggtgggctgtaccctgcaaagccacaggggtggaactgcccaagagggcatgggagctcacctcttgcatcagcaggacctagatatgagacgtggagtaaaaggagatcatttcagaactttaaaatttggctgccctgctggattttggacttgcatgaagcctgtagtcccctccttttggctgacttctcccatttggaatgggtgtatttacccaatgcttgtatccccattgtatctaggaagtaactaacttgcttttgattttgcaggatcataggtggaaagaacttgccttgtcagatgagaatttggactgtggacttttgagttaatgctgaaatgagttaagatttcagggagctgttgggaaagcatgattgtttttgaaatgtgagaacatgagatttgggaggggctaggtgtggaataatatggtttggctgtttccccacccaaatctcaccttgaagtttaataatccccacatgtcatgggagggacctggtagagataattgaatcatgggagtggtttcccccatactgttctcacaatagtgaataagtctcatgaaatctgatgattttataaaggagagtttccctgaacatattctcttgtctgccaccatgtaagacttccctttgcttttcctttaccttctaccatgattgtgaatcctcccagtcatgctgaactgtgagtccattaaacctcttccctttataaattacccagtctcagacatgttttatttgcagcatgagaatagattatatagttcccttctccccatctcttttagggacacccaggagtcatagatttcttctttatgtaatcccacatctctcagggattttgtttatttctttttattcttttttctctatttctttattacagtcttatttcagaaagacagtcttcaagctctgagattctttcctccacttggcctaatctgctactaatagttgtggttgcattgtaaaatttcttgcagtgtattttttagctctattaggttggttaggttcttttctatactgactattttgtctgtaagttcctgcattgtttatgattttttagcttccttgcattagatttcaccttattcctatagctcaatcatttctatccatattctgaattacatttctgtcatttcagccatctcagccagttcagaaccttgctggagaggtgatgtgtgtttttggaggtaaaaaggtactctggctttgtgcgttatcagggttcttgtactgattgtttctcatcttctgggcttatcttccttcagtctttgaggatgcttacctttggatgagtgttttttcttttatcctatttaatgaccttgaggatttgattgtggtataaggtgcagtcagctaactggcttcatttctggaagattttagagatttggtcctcagctctcaactcctgggcttagttctctaactttggaggacttgtgttgggccccactttgttctctgtctccttgagattaggaatctgctatcctgggggcactgaggtgctcctggaccactgtttactgcactctgatgggtgatgtcagccaaaatgtttcgtggtgtagtgacagtgggatccttcttgtctgcatttcagcagcattggtagcagcagctgtggcagagtgctagtgggtgctgggggtcctgcctccctgtgagcattcatcgcagtggtggaggcaatgcagctagaggggtgtgtgttgcctgcgactgtgcagtcgcactcaaggtggtgttggcttgggagcaagatgttggcaggcactggtctgggtgccttctttgtgccctacaagcaggagtggtccctcagggcaggggtggatccacttttctctgtatagtgtttgcataaggcagggtgcttgcagggggagggctggtttgctctgtgcccatcaatgctccatctgcaatagcaatcagcaggcggcagaggggctgactgcactcctgcatgctggtgaggcaacaaaagcaaaacctgccctgtgcagccacatgccagcaaaacaatgtgaggagttgccaggggcccagaggaagccgcagtattggaagggaatgtgtggactggtgtgtgtccataggcactgcccactggagctctccatctgtcaggcgtgatccaccattgcaaaagctatggtgtgggccctcagggcaccaaaggctgccctgcaactatgtgtggccaggctgtggccccaggagagtctagcagaccaaggggtgctcaggttgtactggtcccatctgatggacaagaccaccctacagaattcagaactgacagttcccctatggctaaagtctcctatgggtgcaaatcgagcctagggggatggccaggcttgcccggggctcctttgcctctgctttagagttgaatgccccaacccactcagcagagaggtgtggtggtgattcccctccaaaactctttcttctcccttcctggcttctttgaagtgttgaaagagagtattcaacaagtatttttgtttcattacttgcttaaataacacctttgtctcatactggaagtccacagtatctggttcttagttcccaataaataaaaccaagaggctgaatagatgagtggttttcaaattgtgattaaagtccttaggaataaagaggcactttggggggcactgttgtaaacaaacaaaacaaaataaaaaacaaaacagccccatcttcccaacagccttgtaaaaccgctgaagcaggtaatgctccaatgctagtcacactaggtcaagtataagtttaattaattagaaggtttttttcccacccttggaccttggccactcctttcttcagtgaccttagggtgagtcacttgctagtccatgggagtttgcagtgctcctgcctgattcccaagaagaaatccatgatcctaccccattacaagagaggatgttaggaccatgtactttctttcctttatgattaaaccactcttcaaaatctactaatttactgagtctgttaagtattgttgacaaagaacctgtaagttttgtgccaaaaagttaaatcaaatgaaatagaatgaaaaacaggaggtcacctggaatggaaaaatgtttatacctggaatccttttatggtcaactttctcggattttaaaaaaattcacttagttattctcaaaaaggtcagcataagcattaatgataaaccttggaattaacctatagcttagagatcttcctcaataacttctacctcatctagaaaaagccaactgaagcaaaagagatgtatttttttcataaagactactcgatttgcaagttaaaatcatttcctaaatagtttcttcaatgacatagatataatagagtagtctgtcgctaagcatattgacatttttggtattgtaaaacccaataagcccaaattaacagcttattcctgtttgaattataaaatagggctctttagagattttagcaagtcgtttgctaaagtactctagaaatttaatttgatttaaaagtttaaaagtttgagggtccttgtataccatgcaaaataatttggagaacacttagtaatctttaaagattaatagtaatattaatttttaaaaacgaatgacaaagttttagtttgagcagttgagtgaataccagcagcaagaaaacgagaccccttgttctctttagtggggactgatattaggggctaaaatctgggcaccaagtgtgttcaatgctactgtggtatttctgcctctaggtctttttgtggtctgagataagaaatatatacaggtatatagacatataaacacctaaatatatacttactacatgtatttttatatacacataaattagatacatatacatgtacacatatatacatgcatataaatgtatacgtgtgtgtgtgtatatatgtatctatttagaaatcttgagtccatgctgataccactgattctgatccagcctcactaagtgcttgctttctctgtttcatgtttattagcccccttttccacagcaagaaaacaagtagctcccaacaacttcgatacatttactaatttgtttactcttataatagatctaaaataatttcagaattgctttgcccatacctctgaaacccttcaggatttgtctggtgttctctaccctgtacatgtaacttgcccaaagctaagggtttatagtcaaatactgtgatcataagctactcagggttgtcctttcattgccacaccgtccctgtaatatgctacatttttctttagaaataacattgggttcatgtttgcgtttgctttcattttctttcctttcttatcctttttcaaattatgtttattctttcagtatgtagaatattaagataacttcatgtcaaaccgtaaaaacaggaattgtcagggaagtgtcacactttgcatatatgttccatacgcttcccctgaaaacttcatagttttcacttttcctctttctttttgtaaagatatgcctgatttcttacttcctaatcttttttacacaaaaggtggcatactatatgtattcttctgcaccgtgcttttggtcatttaacaatatgtctgggaaattgctgcacattagttcataagtatcttattctttttttttttacagcttcatggaacttagagagcaacaataagctagcgattcagagagagagaaagacagagagagagagagaaagagacagagataaagctactgttgtatgatgtgggaatctggggaaagaagataggtaaaaaacatattttggaagttttctttgaggtgtgaggtgtgaggtgtaattcactgtacatccttttcccctaataaaaatctcagaaaaggccactcttctgttctattgaatatgtcactttgatgaagcaggtttgaaagtgaaacacgaaggttgaatttgaattacaggagagcatcaatgctatcatatggtgagtcatgtaaaatttctgtttcaagtgtagctaaagttagagggtccttccagggctggctgtgctgcaagaagaggggcagtggatgtccagatccttgtcctctggaaattgggatttcgaggctagtcatagacagggagatttcgcaatagggtaatagagactgcaaaataagctgagtcagcagagccacggaatccgcatgaaataaacatttcattgacagcctgggatccacagggttagatgtagacatcagagctcggttattgtgcccaaatctgagaactggagatgaaaggaggcccaaacatttcaagaataaacagggagggactcaggatgatcttccagctagaacaagcacgcttttcacagcttcttttgaagttctgcttgggtgtggtgggtcagctgagtttaacagatctaagacacaaacacgtagaaatccaaggcctggaatagaatggcatagaaaaggtccagagaaggagttaaagtgagtaaaatataagcatgaagggaacatatttgaatttgacttctatattttggaaagagatctaggatgagatgtaatgaaggagccttattaaacaaatcctagaatacccaaactcaagttcttgagtagatatgtctgaaaattaagttatattttaaatatcaggtagtaaatataagtaatttacttccttactaggctgagaatatgcctcgccgccagtataaattcttaggtgagtaatttagaattaactgaaagaaagtagacacattcaagtaattatttttctttttggtaagacaggatgtaagagcttatagtgtgatcaattgcagaacacctttcccacttcttctttctctgtttactcctttcctctttcattattgaatttgtgacaaacatctataataaaacctgaaggccaagagaaaaatatacttggttaaatttgttgaatgggctgtatttaagggttttcttagaattaaaaaataaaagggaaattaaatttgatttaaatttttagatagtcataacattttttctgagcttaaatttttttttttaaataaacaaataattgtatctacttatgggcaacagcgcagtgttttgatatatgtattcatccctgagtttgtcctgtagtattatttttggctgtcagatgaagcctagggatgccttcaaatagtgatttgtaaatggatgtaacaaaatacacagaattactaaagaagtcaattaaattgaaatatagctaccaaaaaatttaaaaaaactgtaatatggtaatatatacactctaacagaataaataacagggaaataactttaggtctattataatgagtaatatgatactggtgaatataaacaatattattttgtgacaatagttacatgctataaaaatatcttaaatttacattggtgaaaaagtcaaagttattgttattacttctatggttttttttaatgctcataattaaatgaaatgacagcttccagttagtcaaaatcaatatttaaatttttcctatttctcagattccctgatttctagggattatggaccccatttaggaaactctgctctaaggaattattatattttatggtatcttaatatataaatatgaaacaaagatacaagtatacaaaaataaatatgtcctcctgtgttggtcgcccaccaccttagtgatttctaatttcaatgatttcatttttaggaattttattaaactgataatttttatatctaatttcttgtcatatacttttatacctatatattttgttaaaaatatttatcacatttattaatttgaatatttatttaaatgtattatttctactgacttttatccatagtgactgatttcattgcatgttttattaattttgtgttatacattttataaatgtattacatttgaccatgtgccttgcatggtcaaatgtaataaggtaattcccactttacctgtgggaattctttgaggcctgattttatgtgatttttctctagaaaggatttatatttacttctttcaggtgcctggagacactaccaacccaggaactgtttaaaccaaaatttcagctttatttttgtttttaagatccacaaaagtattgtgaccagaaggtcctaaatctgtgtgtgagtgcaggattatagttagtaattttctggatagattccttttttttgacccagatctaaggatgaatcaagaaagtatctttatgtctccttgaaggtgtggccttttagaaatcccagatttaggtgtcttttcccatcttattgactccctgggtcccatagtgggtcagcagatgctcaccaggcaaatgcaggcccaagtacttgcttaactctctagtcatgtctgtttttcattgtttttggcctctgagaatttctctaactttcctgcctactcaggcttgcattagttcataaaaaattactttatacagctttttaaaaatttggttatattctctactgggaggaattctttggatagctagaacaccatttgtaagatttggttctgattgacattctatcttgtttaattttgtttaatctttacaataatcctgtgaggtatctctcatgtcccctttagctataaatgttgaaaagagagtcagcaagagcagctaaactgctcaacattatatagcaaatcagtggcaacggtgggatttcaaacaatgtctgctaggccactggcagaagaactcatgttctttgccttttgctcccctggttttcattctgggctttaacacagcgttataccatgtacattataccagaatgttaggtctgttctatcagagagttttgtctattttgccctctcacatacaaccagcatctagagcagagccgactcacaagagaaggtcagtaagtattcatttgatcaacaaataagtgaatttttacgctaccacataatcttcataatgataaattttgaggctgcttaacaagccatttgagttggttaattaagaatctcttttttgaagatcattgtgtttttaccttagtctaagaaaaaaaatctatatgtactaagatgtcattgtaagagctatcttataaggacaaacaatactcaggaaccagtcaattatttttctttcttgctgtgtctctgtcccacattgcctaaatccttttcagtgttgttttgttttgtttttaaatcaaatcacatcacatcatgaagttcctgcatttcaacttgtcacattggtctgatgggttccccgctcctggttttgagagcttcggaggtggctccctttcatcttctgtactattctttgtagagattagtcacaacaacaacaacgtgatcctaggcatttcttctcctgtgcagctgactgtgaagcaaagtaaaagggcaaactatttataagtcaagcggttacaggtgcagagaatagataagtatttagctttgtccaggttgggagactattcttactgaatttccttgtttgggctattgtagcataggctcacatttacaggcaggtctcgagctttttaaaaagcatgtcccagtggctgaacttaatcccacctaaactgccttgagaaatctgtcagtcaatgtctctattatcagttgatgtttttccagtcaaaaactgttaagtaacatacctactataaactaatgctatgcgaggaagaggtaaaattcacaggggacagcaaagaaattagtaatgtatggaatacttgctatgactgatatatatgcagccatgggagcatccaccggagaactgctccctttggtgtgggcagggatggctccccagagaggagtcaggaaagtatatcaatgttccttcgaaggtgtggcttcttggaaatcctagctttagggggtcttttaccttctcttaccttctccagttattcacaaacagccttaccaggttcattgttcctcaacatttttctcttttttcatccttttcctcccagcttggatttgtatctattaattactaatagatatgatgatttattgtttacaattaaggtgtaatttatttctccaggaagagagaggaacagctatggttctaactcctcctcacccctgataattacatgtattaattaagtcctttaatatgcatgcacctagcaaacacttttcccagtttgtccctgaaatgctcttgtttctatttcctgtattcaaggagcaacaattctttgatgctcacctacccttgtttatttgctttttaaaatttatgtacttacttatttgtactcttgctcaccatggtctctcttgcctctcaaattgtaggagtattgaatatatcattcttactaaattagctgtttgatcccgctacaaatccagtatttttatcttgaacttttttcttttaacaatgtgtgtgatatttttcccaattaattctttggagttcaagggttagatgttatttattgtgcttcatgggtttgtttttagatttaacatgttaatatacacaaaaataatactaaaatgcttaggctcataaaataaatattaatttcccggagtttgtgtctttttgtcctttccttttaaaatttcctttattgtatattcattcattctttatttctgtaacaaaaagttccaaaatatctttgttcttagcactttgcagacatagggtgtacacaaactcataagatatggactctgccatggaagatgggaggacatgctgtttgaatacatcaataaataagaaatagtttcatgctgtttttgttcagtatgtatttaatgataggttttactatttctttgatgtgtgtgaagcttctattactttctgagaattttgtttactgagtcaaattttctgcctagaggccttaagctgctgtgacagacatgttgaaatttttataatgcgtgaatagagtatcagtgttgaggctcagtgcagtgcatttgagaacattgttttttctgtaaggaaacaacttgctatcactctgacctaggcaacagatttacagatgcacttaggaaatctagtgatctttactatctgctatctctaaatgtgactgaattgcattgaataaatatttactgagagtctactaagaagagcctccaagattctgcattagatttgtacagaagtcgctgtaacatgctaggagagccatcagaggagacagaagcaaactcatggtggtaagaggatgcaggagtctgtggtggctgtggtcttaggaatatttcagggtatcaaggaagtaagctaatgaataatttctgaaagggctttgaatacttggctggcaatggcaagttacatatgaccaacctaattatcactttgcttctcatccaataatgagtcagtgtctgtctggtgaggttctgacacacccaaagtgctctgccagcagatatatgaaactctgaagaatagtcttcatatgatctttggttgtgatatgattaggagggagtagtctgaattgtggggctccctgaagtcttcaagcagggttctggtccgcaagttctctcctggaaggtgggaggggtcctgaggggtcatgatctattcaagcccccatccaacccccacatcactaaacattcccatttgtgtcttctggtgcttcatgttacatatgaagtacaaagaccattgaatactttcactttcattttggaaatcctatctattgagggtaggaaatgtggtttctagggtttgttgaccatttggttacaatttgggattgcaactgacttgcaggatttcagacaatgcaaaggcaaagtctagtctattcctggaagaaaaatcatgggatggggagaccttttttatctatgccactttttaacctttttttggaggtactggcagttatagccacataattctattaggccatcgatggctgggtctagatctgtgactttcaaattaggtcttaatagggttggaatagggttatagtggtgtccattgtaaattggttcctaaaattttatttatgtcccatctactcctttaacaaatatgccttaagcacttactatgtgagggactctgtgttaattcttgtcaagagatataaaaatgtatagtcttggccggcgcggtggctcacgcctgtaatcccagcactttggtaggccaaggtgggtgggtcacgaggtcaggagatcaaaaccatcctggctaacacggtgaaaccccgtctctactaaaaatacaaaaaattagccgggcatggtggtgggcacctgtagtcccagctactcgggaggctgaggcaggagaatggtgtgaacccgggaggcggagcttgtagtgagcctagactgtgccactacactccagcctgggcgacaaaatgagactccatctcaaaaaaagaaaaaaaaaagtgtagtcttgcatgcctctttatcacctgtcaagggtgataagtttaaaacaatttttttcctctgggatttgaagattttctcctgtttcttttcttcactatttcttaagatgagagtctctatgtcctgtgaatatgtaataagcaaagaacaaaagtagttttctgacctttaactgtttcagaatagttttgaatatattagttaaaatagcataatattatgtcttcaacatgaatacaatatcttaaatttcatgaaacatggcacacacttgttctgtgtagtaactgtaataaggcagacatcgttaaatgccctattttgtagatggtgactcagaggtcaagtaatttcattatgactggccaagtggcagaacctgaactggaaaggggagtgtggtgccctttccattgctttacatttccttgtaaatgtcaagagcagctgaatgttagtattcttttcaaactgcaaagtgacttttcagcaattggggttgttgtttgaaatgtttttgaatggcttgtcttctatctttccctcataggaaaagaaaaatacgacacatagccatgattgaagacgtgtaccttcatctgagaagacatctgcaaatattctggtcactattaaactatatccaatttttaagttgtttatttttaagtgagggctgtttttatagataaagtttaaaaagtctggcattgttgacatatattttacattaacctttgcttttggaagaaccagatattcccaatgttagtgtaatcgatcgtatttttttgattgttatgtggcagttgcatgtattacgtttttaagttgtcataataacctggtgagagaagtactattattatttgacttttgtagatgagaaaattgagagacagaaaagttaagtgacttgcccaagtttatacagctagcaagtagaaaaactgagatttaaactcgggatggacttgttccagagcccatgtttttaaccacagcattatactgacccgtcttggcactgcactgatgaggtgtgtgatctttcttaggtcacctaatggttttggttttcagattcatttatgagaaggagaatgcatgggataatttattttctgagcagtattccttgtatgcttacatgcctttatttagtcctcacaagaaccctagacatagatagaattattatcatccttatgttacatatgggaaaattagaacttagagagttcaagtaactgctaaaggtgacataatcggtgtaagaactgggaatcaccgccaagatttcaatcactatgctttactgtctttcctttttaggggcttatgctgccgtcaaattctttacattgaatcctggctttttattttagagtcataatggcaatatgtttgtttcataaaacctttcatttagaattcatccaagaagtgacttagtctacttatggctgcaaatactggggagccattagcacagtgacagcaatcttaacaatgaaacattgtgctattaatattatattattatttttttgaggagtcacatgtgtagcaaacaggatgtaaccggacatgtcaggcaagctgttgctaaccctgaagactacaagggattaaattctcattattcctcagagttagtccccaaatatctgtgtatgttcagtttcttcagtttggcaggaagttttaaagaactaaacagcatgcccttccgcctgtggcatattcataagctatttttgggtgagtcatcggaattctgtggtttgtatcctgaagggggagaggagacactgtatgtttagcctttttttttttttttgaaacagctagttgaaaaaaaaattctttgataaaagttcaacattaggtaagaaatatctgcggcaggatctttccattgtgataaatattcctctcatgttcacatctctgggaatattatacaagtttaattatttgacctgtgcatattcatggcttgacctagtgcacacagaagctctggtctggtgtttagctgaggcaattcatggggaataaacaactggctaaatgagtcttcttctgtccttggagtctgctccctaatgtcaaatcaatgcagtaagctggatagagttgtggacatttatgaaaacacaaagaccaagccaaaccttttgaggcctgttaggtaatataactaatactgtaattgtgggttatgattaaatatttgtaatggtaaaaaaaagaagtgggtgaaaattgacagtctttttctttgtaacaacaagagagcctaagagggaattccagtaattaatacatattttcctatctcatcaggaaaaggagctgattgttaatggaagaaggaagaaatacaagtttgttgggtatttagtatatgccagacgctgtactagggctcaaaaaaaattccatagagaccatttagatctggcgaacatactactttcagaaactgaagcgagtttgtggtctacagcatcagtagtccataagacagagatttaagaaaagaaatggtggtatttaacacccctgttcaattatagttatccatatgatatgactgactgatttgtgactgtcaacagacgtattcatagaggacaatttcaagttaatcttcaaaatgggagagttaaattatttttaaaaaataaagagtgactactgtttggtccttgaaatgatgttaggtggatcatgaattaggcattaaatggcattaaaacacataatgagaaaattctctctttttaattccctttcagttttctgagtatgtcaagcaggaagtttcagtgtggtgttagtgaaatgttagctcttctcagggcaggcaacatctcccttcataacactcctttttagagttacattttattatgttttatttctggcaagtgaaattggtttccatttatatggagtagatattaaaaatgtattcatatgaaatattaattgatttaaaaatattaactaaataatacatgtagtgagctgaatgggcaatgggacaccaccctgaagaaattatccactgtgtaaaacttcacaattttagtgattaagaggcagatggtttcataaaagaaaacaaaaaatatagtttgtttaagatctacctgcttgtccagagcagttgtgttcaaagtgtggtccatagacaaatgatggtctatgaactttttgcctgtctggaaaaaaataaatatagaactcgtgagtaaccatttagaaacttttatagcttttatagcttatagcttattgctttcatatccaattgcacaatatatttttctagtaattgtttttggtattttacaaaagtgtcattctgtgataaattaggggaaaacctaatcatttgagagggattgatctaaaacatatatttagaacaagaacaaaactaagaaaagtggtagtctaagcagttatggaaaaagaacatgcattggcagaaagtatgcaatcatcacaggatctaaaaaataggaataaagagactaagatggtacctttgtaaggattgggactgtcacaattatcttatggttgtatcccaaggatccagtgtaggtcttgtcatataatcagcatttgataaatatctgtggagtgaatgaagaagtaaatgaatcagtgaatgagctatggtgcttggcaagtaggtctaatgcaatcgccagagaaaatgctctattacattgcagtaattgttcatcatgcttttccatttataacactctctaattccctttttttctagatatataaatatcaagtcaacttccaagtatgtattaattagcttgtcagtgaatcttgattccaaaaatgtggtgcctcaatttaaaataaatacttttaaatattgggttgaatactacaacaggaagcatagactggattgtgtttcagtaggaaaaacctcactgtctcaatggcttaatccaacaatcacttatttctttctcacatatatgtctaacaaagactgacatagggctttgcttattacagtcatctcaacctgtgtttccatgataaccgtaacaaaagatgtagcaaataacacactgcctcttagagcttctgcctggaagtgacacattttacttctatccactttttttttttttttttttttttggcgaaagcaatgaattcacatctaatatcagcgaggtagggaaatgcagtcctactatgtaccaggaaactggaaagccagaaaaatttcttgaagaacactactaaccagcatatacacccatatgaattagattaacaataattattctacctctggttgatcttctgtgattgtaccaacagcactgagtttatgcactgccagataactgggctgaatcgtcaatgtggtgatcccgtgaacatactgctgttgatacacttctgcctcagctgtcagcttgcttactttagcagcagctctgttttccattctttctaatatcaatagtgacatctgctacagaataccaacttctctggtttgaattctctctctaccaactaaacattacaactgaatatttcctcccatgagaaggaaggtgattggccttagatcttgctctgagagatttcttctaatgaattttttaagtggctgcaaatgtaaactttctgtaaatattcttgtgtgagattgttagaatgagtcaggttccaggaagctgatcaagcctgagaaaattgaacatatgaaatttctagacttgcaaacttgagaaagaggcctgaggtcctagtgatctatagtattcatgctatgagtgttcaacagtttctgtctgtctgtctgtctgtctgtctgtctctctaacctacttattttctaaatgtcttccaacacaggacataccaacatgtctaaagtgggctggaaaggataattctgaggtacataaacatttttgctctgtaatgcaatataaaatatctccaccccttgctaatagttttgcataaagtacttaaaaattttccagaaaaaaagatttaccttaaagacatcactttttttaatgatactgtcagcattatgtggacttccaaaattagtggaatctgaatccagatgggtgaaatctaacggcacactagagaaaaccatgattttcaaaattataaataaatatcaaaacctcaatatctgcctctgtctacaaacagatgacagaaggaggcagacgtttgagacttcaaaatatgattagtattaacagccaaattagattactaaatttcttaaaagccactttgaagaggcttttccccaagctgtctgtattgaacgtattaacagaatgatttccagaactttacaagattgtgccagtggacacagactaatcacccgctgaattatgggggaatgggggaggattttttattactcctacatcagctgtggcacatctagacatgtaactaatcatttattagcctctaattttggaagctggctttagacgataatcctcataaaaagctaacaaggagatgcctttgataaggcagtaaatcactaagtagagaaataagcagttgatttatgactacttaaatattttagtctctgaaagataaacctccatttctgttttgcaagtgacattcctattgttccttaaaaaaattaaactttgattacgtgatgcagacagaacatatttcccccagtttcagagattgtagttgagtgactgaacttaaatactaagatcacttccaatttccagagcctactcactcagtttcttgaaacagtctgtgtctccagagcaatcagcctggcattggcagagcaggtgctctgttagtatattctggtgtgtagtgcatcaatcctgtgttaaaaatttaagattctataggtaaaatattactcaaatcataaaatattgtccttttaaaaaaatctaacacatccttcatgttcttgtttcaggacctttgcatttgtcactccttgtagccagaacacccttctctgagatattttgtggcttattcctttatgtcttccaagtctttgttaaagtcttgccttcttagaaagaccacagctggccacattttctatagtatcacctcactcactttctagccgtgctgttattttcttcataaaaccgaactctactaacacattaatttgtctatctacttatctttcttctttattagaacgtaaactccatgagatggagtggtagtagtgtgggaagtacttcatattgtttataactgtttctatagtgcctagattaatgcttacatcttacctgctgagcacttaatacttttaataaaagaatgaaagggggttggagcaaggtgaagaaatagaaggccccaccgatcatcccccaacctacctccgcaaggacaccaatttaacaaatatccacacacaacaaaacactttcatgagaaccaaaaatcaggtgagcactcatagtacctggttttaaattcatatcgctgaaagaggcaccgaagaagtagaaaaaacagacttgaattgcctatgccatccctccccccttccttggcagtggcaatgtggtgcagagagcttttctgcaccctggggagagggagagccagcaactgtgaggcattgaactcagtgctgcccttgttatagctgaaagcagagccggaccaaactcagctggcaccctcccgcaaagacagcatttaaaccagccggagccagaggggaattgctgatcccagcggttggaacttgagttcctacaagcctcaccactgtgggcaaaagtgctttggggcttcaaataaatttgaaacgcaatttaggcctcaaggactgcaacaccaaggtgagtcataggctgaactggaccaagagacagtagactgtggttgcatgcgacctactgcgacaccagctggggcagctaagggagtgctggcctcacccatccccgaagcccaggctgcaaaaatcctggctgtaaaagagactccttccttctgcttgaggagaggagatggaatagtggggaagactttgtcttgcatcttggataccagctcagccacagcagaatagagcaccggtcagagttgtgagaccctcatttcaggccctagctcctggacatttctggacacaccctaggcaagaagggaattcattgccttgaagagaaggactcattcctggaaggattcatcacttgctgcctgaagggaccctgagctgtgaataaccaacagggatatccaggtactacatcaaaggtcttaggtgagatgctgagactggctggacttaggagagactcggcacatttccaattgttgtagctgattagggtgagactcctgcttgagaaaagtgaacagaaaagtaaaggaaactttgcttttcactttaagtatcagctcagccacaatggaatagagtaccaagtgggctcttagggaccccagttgcaggacttgacttgtggatgacatttctggtacttcccattgccagagaggagctcactcccctgaagggtgagtcctagccaggtaatattcactacaagctgactgaagagcctttaagccttaagggaacatcagaggtagtctagtagcagtccccaggggtctgaggtagtgatatccactgggtgaggctcctctgcctttggaaaggggagggaagagtgagaaggactgggtcttgtagttcgagtgtcaactcagccacaagcaaaagagaaccctcgtacactgttggtggtaatgtaaattaataaattaatacaagcactacggagaacagtttggaggtttgtcagaaaacctaaaaatagagctaccatatgagccagccatcccactgcagggtatataccccaaagaaaggaaattagctgttgcagctctgtttacaacagctatgatgtggaagcaaactgcatgtccttcaacagatgaatggtaaagaaaatgtggtacttatacacaatgaaatacaattcagccataaaaagaacaagattcagtcatttgcaaccacatggatgtaattggatgtcattatgttaagtgaaataagccaggtacagaaagacaaacatcacgtttccacttacttgtgggatcgaaaaatcaaaacaattgaacccatggagatagagagtaagagagtagacaggtcattaccagaggatgcgaaaggtagtggggggttgagggagaagtgggggtggttaactggtaccaagaaatagttagaataaatgaataagatctagtatttgatagcacaacagggtgactatagtcaataataatttaatgctacgtttaaaaataactaaatgagcatagttgaattttttgtaacacaaagcaaaaatgcttgaggggatgaataccccatcttccatgatgtgattattatgcattgtatgcctgtatgaaaacatctcatgttccataaatatatacacctactgtgtacccataaaaataaaaaataaaataaaaagaatgaaagaatggataaatgaatgaataagttgattaatccataagactggaaaatttctctggctcccaggagcatattgctttttttctctaaacttagttaatatgtagtaaaatcagatcttaatataactttttgtgatctatcttgtgacaatagttatataatataggcttattcttttatgaagataatcatttagttcttttttctcagtatgctgtatccaaatttgaactaaagtggattaaacaggttttatttgtgggaaattagggccttagaataatgaggtaaattctgatagcaaatgctacctctcttcagtttgtagtgagaaaatgttagctttttaaataacaaagatgaggccttttagacatagttaattggtgcaagctaaaaattctcaaagttctaaaatttgcatattctttgcatgtatgtagtctttaggaactcatgacaaaaggatatatttttaaaataatgtggaaatttgaaaatgaaatctcttttccaattctaaaagagcttttcttttccccccaaggctctacagttttaatttagcactgtattaatcaaataataaccaaatagggtttattttaaaaatccaaggatgtttaaattaagaaatccattatcatatttcatccgcaaagaacttttctaacatgctgagggctgagaatcgcaaaagactgcacccccccaccactgcttcttagaaaatttcttttctgtaaaaaaatggactcataaacagtctttctgaattccaacagcatgttcacagaagcacttgggcaggagagcatggtagacaattttggatctgagcttggaagatctgttttcacatctcacagtgaaaaaacaaatctatggaaagaaatttgaaaaaacatgctagtaaacccagtgcctaggattttaataatcctaaattagaataaatacttattatccagctctggtatcctatttcctctttggaacgctcacataggcagttcagaaatatttgtgccaatgtttccttgggaacatataaaaatggtagaaattatgaagaataagtacaccagggtaatatcattttgtgaataaatacaatttatatttgttttcagccgagaatttcctagtagcatacatgattttgttataatttaattaggttcacatagcaagccactcctgtaaatggctgtgattattactctcatgtcaagttcttcagaactcctcacccacttgccaggtgtgtgcagggagagatcacgaagcatgaaagcaggaatcatgtaggtctggaagacacattatgtagacatgagacagtgataaattagtggaatcgagagatgtgtcctttgcattaaatagtcatcagatcctgagaaagacagttattctgtctggcctccatttgttttaggagtggcgtggagatttgacggaatataacatttccatgccatttaacttgttgtgatatgtgattcattttctgagacaatagcattcatatgtgtgtaggttatgctcgtgaaaactgattacttcctacttttattttataactaatattttttcttttttctttttttaaaattttattattattatactttaagttttagggtacatgtgcacaatgtgcaggtttgttacatatgtatacatgtgccatgttggtgtgctgcatccattaactcgtcatttagcattaggtatatctcctaatgctatccctctcccctccccccaccccacaacagtccccagtgtgtgatgtttctcttcctctgtccatgtgttctcattgttcaattcccacctatgcgtgagaacatgcggtgtttggttttttgtccttgcgatagtttgctgagaatgatggtttccagtttcatccatgtccctacaaagcacacgaactcaccattttttatggctgcatagtattccatggcgtatatgtgccacattttcttaatccagtctatcgttgttggacatttaggttggttccaagtctttgttattgtgaatagtgccactataaacataggtgtgcatgtgtctttatagcagcatgatttataatcctttgggtatagacccagtaatgggatggctgggtcaaatggtatttctagttctagatccctcagcaatcaacacactgacttccacaatggttgaactagtttacagttccaccaacagtgtaaaagtgttcctatttctccacatcctctccagcaactgttgtttcctgactttttaatgatcgccattctaactggtgtgagatggtatctcattgtggttttgatttgcatttctctgacggccagtgatgatgagcattttttcatgtgttttttgggtgtataaatgtcttcttttgagaagtgtctgttcatatccttcgcccactttttgatggggttgtttgtttttttcttgtacatttgttggggttcattgtagattctggatattagccctttgtcagacgagtaggttgcaaaaattttctcccgttctgtaggttgctttttcactctgatggcagtttcttttgctgtgcagaagctccttagtttaattagatcccatttgtcaattttggcttttgttgccattgcttttggtgttttagacatgaagtccttgcccatgcctatgtactgaatggtattgcctaggttttcttctagggtttttatggttttaggtctaacatttaagtctttaatccatcttgaattaatttgtatataaggtgtaaggaagggatccagtttcagctttctacacatggctagccagttttcccagcaccatttattaaatagggaatcctttccccatttcttctttttgtcaggtttgtcaaagatcagatagttgtagatatgtggcatcatttctgagggctcagttctgttcccttggtctatatctctgttttggtaccagtaccatgctgttttggttactgtagccttgtagtatagtttgaagtcaggtagcatgatgcctccagctttgttcttttggcttaggattgacatggtgatgcaggctcttttttggttccatatgaactttaaagtagtttttcccaattctgtgaagaaagtcattggtagcttgatggggatggcattgaatctataaattacctttggcagtatggccattttcacgatattgattcttcctacccatgagcatggaatgttcttccatttgtttgtatcctcttttatttcattgagcagtggtttgtagttctccttgtagaggcccttcacatcccttgtaaattggatttctaggtattttattctctttcaagcaactgtgaatgggagtttactcatgatttggctctctgtttgtctgttattggtgtataagaatgcttgtgatttttgtacattgattttgtatcctgagactttgctgaagttgcttatcaggttgaggagattttgggctgagatgatggggttttctagatatacaatcatgtcatctgcaaagagggataatttgacttcctcttttcctaattgaatgccatttatttccttctcctgcctgattgccctgtccagaacttccaacactatgttgaataggagtggtgagagagggcatccctctctcgtgccagttttcaaagggaatgcttccagtttttgcccattcagtatgatattggctgtgggtttgtcatagatagctcttattattttgagatacatcccatgaatacctaatttattgagagtttttagcatgaagggttgttgaattttgtcaaaggccttttctgcatctattgagataatcatgtggtttttgttgttggttctgtttacatttattgatttgcatatgttgaaccagccttgcatcccagggatgaagcccacctgatcatggtggatgagctttctgatgtgctgctggattcggtttgccagtattttattgaggatttttgcatcgatgttcatcagggtattggtctaaaattctctttttttgttgtgtctctgccaggctttggtatcaggatgatgctggcctcataaaaatgagttaggtaggattccttctttttctattgattggaatagtttcagaaggaatggtaccagctcttctttgtacctctggtagaatttggctgtgaatccatctggtcctggactttttttggttggtaatctactgattattgcctcaatttcagagcctgtcattgatctattcagagattcaacttcttcctgctttagtcttgggaggatgtatgtgttgaggaatttatccatttcttctagattttctagtttatttgcgtagaggtgtttatagtattctctgatggtagcttgtatttctgtgggattggtggtgatatcccctttataattttttattgtgtctatttgattcttctcccttttcttctttattagtcttgctagtggtctatcaattttgctgatcttttaaaaaaaccagctcctggattcattgattttttgaagggtttttttgtgtctctatttccttcagttctgctctgatcttagttatttcttgccttctgctagcttttgaatctgtttgctcttgcttctatagttcttttaattgtgatgttagggtgtcaattttagatctttgctgctttctcttgtgggcatttagtgctataaatttccctctacacactgctttgaatgtgtcccagagattctggtatgttgtgtctttgttcttgttggtttcaaagaacgtctttatttctgccttcatttcattatttacccagtagtcattcaggagcaggttgttcagtttccatgtagttgagcggttttgagtgagtttcttaatcttgagttctggtttgattgccctgtggtctgagagacagtttgttataatttctgttcttttacatttgctgaggagtgctttacttccaactatgtggtcaattttggagtaggtgtggtgtggtgctgaaaagaatgtatattctgtttatttggggtggagagttttgtatatgtctattaggtccgcctggtgcagagctgagttcaattcctgggtatccctgttaactttctgtctcgttgatctgtctaatgttgacagtggggtgttaaagtctgccattattattgtgtgggagtctaagtctctttgtaagtctctaaggacttgctttatgaatctgggtgctcctgttttgggtgcatatagatttaggatagttagctcttcttgttgaattgatccctttaccgttatgtaatggccttctttgtctcttttgatctttgttggtttaaagtctgttttatcaaagacaaagattgcaacccctgcctttttttgttttccatttgcttggtagatcttcctccatccctttattttgagcctatgtgtgtctctgcacgtgagatgggtttcctgaatacagcacactgatgggtcttgactctttatccaatttgccagtctgtatcttttaattggagcatttagcccatttacatttaaagttaatattgttatgtgtgaatttgatcctgtcattatgatgttagctggttattttggtcgttagttgatgcagtttcttcctagccttgatggtctttacaatttggcatgtttttgcagtggctggtactggttgttcctttccatgtttagtgcttccttcaggacctcttttagggcagtcctggtggtgacaaaatctctcagcatttgcttgtctgtaaaggattttatttctccttcacttatgaagcttagtttggctgcatatgagattctaggttgaaaattctttcctttaagaatgttgaatattgacccccactgtcttctggctcatagcgtttctgccaagagatcagctgttagtctgatgggcttccctttgtgggtaacccaacctttctctcttgctgcccttaacattttttccttcatttcaactttggtgaatctgacaattatgtgtcttggagttgctcttctcgaggagtatctttgtggcattctctgtatttcctgaatttgaatgttggcctgccttgctagattggggaagttctcctggataatatcctgcagagtgttttccatcttggttccattctccccgtcactttcaggtacaccaatcagatgtagatttggtcttttcacatagtcccatatttcttggaggctttgttcatttctttttcttcttttttctctaaacttctcttctcgcttcatttcattcatttcgtgttccatcactgataccctttcttccacttgattgcattggctactgaggcttctgcatttgtcacggagctcttgtgtcttggttttcagctccattgggtcctttaaggacttctctgcattggttattctagttagccattcgtctaattttttttcaaagcttttaacgtctttgccattggttcgaatttcctcctgtacctcggagtagtttgatcatctgaagcattcttatctccacttgtcaaagtcattctctgtccagctttgttccattgctggtgaggagctgcgttcctttggaggaggagaggcactctgatttttagagtttccagtttttctgctctgttttttcccatctttgtggttttacctacccttttgtctttgatgatggtgatgtacagatgggtttttggtgtggatgtcctttctgtttgttagttttccttctaacagacaggatcctcagctgcaggtctattggagtttgctagaggtgcactgctgacgctgtttgcctgggtatcagcagcagcggctgcagaacagcggatattggtgaaccgcagatgctgctgcctgattgttcctctggaagttttgtctcagaggagtacctggccatgtgaggtgtcagtctgcccctaatggggggtgcctcccagttaggctactcgggggccaggaacccacttgaggaggcagtctgcccgttctcagatctcaagctgcatgctgggagaaccactactctcttcaaagctgtcagagagggacatttaagtctgcaggggttactgctgtctttttgtttgtgtgtgccctgcccccagaggtggagcctacagaggcaagcaggcctccttgagctgtggtgggctccacccagttcgagcttcctggccgctttgtttacctaatcaaacaactaacttggcaatggcaggcgcccctcccccagcctcactgcagccttgcagtttgatctctgactgctgtgctagcaatgagtgagactccgtgggcataggaccctctgagtcatgtgcgggatataatctcctggtgtgccgttttttaagcccgttggaaaagcgcagtattagggtgggagtgaccagattttccaggtgccgtctgtcactgctttctttgactaggaaagggaattccttgaccccttgcagttcctaggtgaggtgatgcctggccctgcttcagctcacgcacggtgcactgcacccactgtcctgcacctactgtctggcactccccactgagatgaacctggtacctcacctggaaatgcagaaatcacccgtcttctgcatcactcacgctgagagctgtagaccagagctgttcctatttggccatcttggttcctccccctttttcttttttctaattacaaacataattcataaaaatagttacttcaactttttatggtatttaaaaatttacataaaatattttaaataatgttttaaatccattcatatatttatttggcaactatccatgaaatcccagctaagtgctagagtgtatatttcttaaagaaatagacatggcccttgctcttgtaagtgttgtagtccagtcctaggtatattctaactttcattaggactttttatttgatcctttaattatttaacaaagtaggtttatgattttccccaaatctattttcttgtaataattatttttactgatttcaaatataatggcactaaggacatacaacatggtctgaatgatgcttactgaaatttactgagagtttttttatggactgatgtgtgaccaatttttataaagatttcatttatgctggaaaagaaagtatattctcttatcattagaaatgtagggtttgatttgtgcccattagatgaattattaattaatctgttcaaatattctttattcctatcataattttgttttatctgttcatcttgtagaaagcatgttaaaattcagcttattgatggtgaattttatcatcttttcctggcagctttgttaattttttttgctgtatatattatgaggctatgttgatatgtatatacatatttaaaatttgtatatgatcctggtgaattgaactagtcaagttctagataactgcagcattggctgacagtatgacaacctcatgtgagagcctgcattaaaactactcggataagctccttctagattcctcacactctgaaaccatgagaaacaacttatgcttgttgttttaagcagctacattttggggtaatttgttacatggcagtagataactaacacaatctcattttctctattttatctttttggaactctaattgtacaattattagacatttttcaatctatctcccttgtctttaaacatatcattcccaatgctttttctgtctgtgaattagtaagtataatttattcagatcttgctcatagtttaccaattcttctttgtttcattataacctggtatttagattatgtatttattattatctatttataactgaaattctatttatttactttctcacatccttttctcatttttgacaaattctaattcctcatatttggctgatcataattttgttttactactaaatggatgatgataagaatgccctaagttccagaaggatttgtgtttctttttgacaagacccggggtgttatcaacctagaagtgcattcaatttattacattggcttcagagttccaggacttttcagacataggaatgaaccctctacctcccaaccttcttgatgggaagcttagaatttcaaaattcttaagggagtattattcttcactgagtaaaggcttaatacagacaagttacaaattacatttgctcacactctagtcagggttaggtgcatgctggtagcagagatgtgaaggtggcattttttccacagcctctgtatctctaagaagactgtgtcaaccctttttcacccaggccagagaggaaaggcagttcttgcagttggtctaatattaaataatatatataaatattatttatatttatatattatatttatatattatttatatttatatattatatttatatattatttatatttatatattatattaggttataatataaatattatttaatatcagttagtttattttagggtctatagggttcataaacttcaggaagcattctgttggtggatggaaaatctctctttacaagtgtctttttcttcatgattcttaggctttataaaggagacccagtgatattaagactcttgcttgggaagtaaactggcgcttcttaaattatttgtggtgacgaatttatttttattatttatcaattctcttcttccattttgtttaaatttatacttcagctttttcttctttctcttggctcataaagtattgacaatgattgtttatctttctgtccatccctgatacaagcattgagaactttaagtatggcattggcagcatcccagattgagatgtggcactttcatgattttattctttagatagtctattgcatcctaagttatcttccttaacagtagtatatttaaagaagaattcactctgctgaacgtgataagaaacagaactcagaaagagggacacctagaggatgaaaacagaagatacaatttcagttgctgataatgtgatattatgcccaaattattcaaataaaaaattcttagaattagttgaattgaatgactaaaaaaataaacatttgcaaattgatttcattcgtctataccaacaattagaagataaaaaggcggggagggaccaagatggcctattagaagcagttgtggtctgcagctctcacaaaatggcaagaaaattctgcaccttcaactgaggtatccagattctcacatgagagccttgggtatgaagcacagagttgtgcagagtctcagcagagtggctgctccctcactttggcacgcagggaaactcaggggttttgcatactctagccctaggaattccagcaaagaatcctgtgcattcccctaggaatggggctgaatccagtgagcccagtgacattgttctgcaggccccattcccatgtcacctcacaagttaagaagcactggcttggaattccagctggccagcagcagtaggctggaaagggcctgagaccacggagttttctgggggaggggcagctgccatatctgtggttccagtctgatgctctagcctgctggcaccgggaccagaagaaattgcccacaatgcagcacagctgttgttcctgaacatgacccatctgcttcttctgtgtttttgttgttgttgtcgttgttgttgtcgtcacccaggctggattgcagtggcggaagctcggctcactgcaagctccgccccccaggttcacaccattctgctgcctcagcctcccaagtagctggggctacaggcgcctgccacctcgcctggctaattcttttgtattttttagtagagacgaggtttcaccgtgttagccaggatgtctcaatctcctgacctcatgatctgccagcctctgcctcccaaagtgctgggattacaggcaacagccaccaggctttttttttttttttttttttttgagaacggagtctcgcccagtcacccaggctggagttaatggcctgaactcggctcactgcagcctcagcctcctggggtcaaacgagtctcctgcctcaacctccggagtagctgggattaaaggtgcccgccaccatgcccagctagtttttttttttttgatggagtctggctctatcacccaggctggagtgcagtggcacagttttggctcactgcaaactccgcctcctgggttcaagcgattcttctgcctcagcctcctgagtagctgggattacaggtgcgcgccaccacacctggctaatttttgtatttttagtggagatgggttttcaccatattggccaggctggcctcaaactcctgacctcaggtgatctgcctgccttggcctctgaaagtgctgggattacaggcatgagccaccacacctggccaatttttgtatttttagtagagacagggtttcaccatgttggccaggctggtcttgaactcctgaccttgtgatccgctcacctcggcctcccaaagtgctggcattacaggtgtgagccaccgtgcatggccccagtctgcttctttaagtgggacctgcatccatccctccccactgggcagggcctccttgccaaatttcagcaactctagccagggttatatgaactgaactctgatttctccctgggatggagtcccttgtgggaggggcagccagctgtctctgtggttcagccaacttattttttccaggttgctggctctggagaggccaggtggtcagcgcagcatacttgatctgccaaggggcaaatggactgcttccttaagcaagttactgatcccatttctcctctctgggtgagacctctcaacaggggtctgcagacacctcctacaggagccttcagacaaacagcggacctctcagtggaaaccctacaagccagaagagattcaacattcttaaagaaatgaatttcaaacccagaatttcatatctggccaaactaagtttgataatgttggggtgatcagacccaacaccgggtcatgggggcgacgaagtccggtggagtcaaaggattgagaaaaagacagtttgagaagtaaagtgggaccagggggccatcgcgattgtggaggctgcaaaggccctgagctccgggagcccatgctatttattggtaatccaacaaagaaacaagtggtgagaatgtgggggtcaaaagggcaggcacatgatctacagctgtgatggtttagcatttataaggaacatgttctgctacttgagataatgggaatacaatcaatctaggagcctaggaggctagaagcaaggagccagcaagtctagacacattcccgaggacattatgtcagacatgcccaccctgcctcagtttttttcccaacactcagctttttcccaacagatgagcaaaggagaaataagattattttcagacaagcaaatccctagggaatccatcaccaccaggcctgccttgcaagagctcctgaaggaagcacaaaatatggaaagtaaagaccattaccaaccactacaaaaacacactgaagtacagacaccagtgacactatgaagcaaccacataaacaagattgcaaaataaccagcaagcatcatgacaagagaatcaaattcacatataacaatattaactttaaatgtaaatgggctaaatgccccaattaaaggacacagaatggcaagctggataaagagtcaagacccatcactatgctgtcttcaagagactcatctcatgtgcaaagacacacatagactcaaaataaagtgatggaggaaaatttaccaagcaaatggaaatcagaaaaaagcaggggtcacaatcctagtttctgggaagacagactttaaaccaacaaagatgaaaaaagacaaagaaggacatacataatggtaaagggttcaattcaacaagaagagctaattattctaaagatatatacacacaatacaggagcacccagattcataaaacaagttcatagagacactcaaagagacttagaatcccacacaataatagtagaagactttaacaccccattaacaatattagacagattattgagacagaaaattaacaaagatattcaggacttaaactcagctctggatcacaaggatctgataaatatctacagaattttccgcccaaaaccaacagaatatacgttcttctcattaccacatgttatttactctaaaattgatcacataatcagaagtaaaaccctcctcagcaagtgcaaaagaactgaaaccataccagtctcccagaccacagcacaatcaaataagaactcaagattaagaaattcagtcaaaaccatacaatttcatggaaattgaacgtctgctcttgaataacttttgggtaaataattaaattaagccagaaatcaagagtttctttgaaagtagtgagaacaaaggcacaacataccagaatctctgggacacagctaacgtgtgtaagagcgaaatttatagcactaaatgcccacatcacaaagcttgaaagatctcaagttgacaccatatcattacaactaaaagagctagagaaccaagagcaaacaaatgccaaaggtagcagaagacaagaattaatgaagatcagagtgggactgaaggagacagagacacaaaaacccatcaaaaaatcaatggattcagaaggtggttttgtgaaaaaagtaataaaatagatagaccactagctagacgaataaagaagaaaaaagtttcaaataaacacaatcagaaatgataagggggatattaccactgacaccacagaaatacaaccaaccatcagagaatactttaaacatctctattcacataaactagaaaatctagaagaaatggataaattcccggacacatacaccttccaagactgaacaaggaagaaattgaatccctgactagaccaataacaagttctcaaatatatagcctaccaccagcaccaccaccaccaacaaaaagcccaggaccagacggattcaaagttgaattttaccacgtgtgaaaagaagagctcatatcatttttactgaaactattccaaacaattgaaaaggagggactcctccctaactcattttatgaggccagcattatcctgataccaaaacctggcacagatacagcacaaaatgaaaacttcaggccaatatccctgatgaacattagtgcaaaaatcctcacgaaaatactggcaaccaactgaatacagcagcacatcaaaaagtttatggggataaacttggcttcaaccctggaataaactttatggggatcaagttggcttcaaccctggaattaactttatggggatcaagttggcttcaaccctggaatgcaagattggttaaacatacacaaatcaataaatgtgatttatcacataagcagaatgaaagacaaaaaccacatgattatctcaatacacttagaaaaagtttttgacaaaattcaacaccatttcatattaaaaactctcaataaaccagctactgaagaaacatacctcaaaatgataagagccatctatgacaaacccacagccaatatcatactgaactggcaaaaactggaagcattctccttgaaaactggcacaaaacaagaatgcgctctctcacactcctattcaacaaaatatgataagttttggccaggccataggcaagagaaagaaataaagggtattcaaataggaagaaaggaagtcaaattatctttgtttgcagatgacatgatcctatatcaagaaaaccccatagtcttagcccaaaagcttcataagctgataagcaacttcagcagtctcagaatacaaaaatcaatgtacaaaatttgctagcattccttatacactaacaatagacaaggagagagcccaatcttgaatgaactaccattcacaattgctgcaaagagaataaaatacctgagaatagagctaacaatggaaatgaaggaccccttcaagaactacaaaccacccctccaagaaatcagagaggacaccaacaaatggaaaaaacattccatgctcatggatagggagaatcaatatcatgaaagtagtcatactgctcaaagtaatttacagattcaatgctattcccattaaactaacattgatattcttcacagaattagatgaaactattttaaaattcttattgaacccagaaagagcctgcatatccacaacaattctaagcaaaaagaacaaagcttggtgcatcatgctacccaacttcaaactatactacaaagctacagtaaccaaggtgatatggtactggtgcaaaaacagacacatagaccaatggaacagattagagaactcagaaataagactgcacacctacagccatgtgatctttgacaaagctgacaaaaacaggcaatggggaaaggatttcctatttagtaaatggtgctgtgataactgtctagccatatgcagaaaattaaaactggaccccttacttacaccttatacaacaatgaactcaagatggtcaagatggattaaagacttaaatgtaaaaccccaaactataaaaaccctagaagaaagtctaggcaataccattcaggacacaggaatgggcaaagatttcatgatgaaaatgccaaaagcaatagcaacaaaagcaaaaattgacaaatgggatataattaaacagcctctgcacagcaaaatgaactatcaccagagtgaacagacaacctacagaatgggaaaaaatgtgcaatatatccatctgacaaaggtctaatatccagagtctacaaggaacttaaacaaatttagaaggaaaaaaagaaatgaccccattaaaaagtgggcagaggacatgaacagacacttctgaaaagaagacattcatgtggccaacaaacatatgaaaaaaagctcaacatcgctgatcactagaaaaatgcaaatcaaaaccacagtgagttaccatctcgtgccagtcaaaatggcacttattaaaaagtcaagaaacaacaaatgctggtgaggttgtggagaaaaagaaatgtttttatactgggaatataaattagttcaaccatggtggaatacagtgtggtgattcctcgaagacctagaggtatattcctttggtatatacccagtaatgggattgctgggtcaaatatcttttgacacatagaccaatggaatagacacatagactattgaccgaataccattaaactcagcaatccccattactgggtagatacccaaaggaatataaatcattctattataaagatacatgcaagagtatgttcattgcagcactattcacaatagcaaagatgtgaaatcaacccaaatgcccatcaattataggcttgataaaatgtggtacatatataccatggaatactctgcagccataaaaaggaatgagatcatgtccttggcagggacatggatggtactggaagccattatcctcagcaaactaacacaggaaccaaaaattgaacactgcatgttctcacttataactgggagttgattgatgagaacacatggacacgtaggggagaacaacacacattggggtcttttggaggatggagggtgggatagaagaatagctaatggaagctgggcttaatacctaggtcatgggttgatctgtgcagcaaaccatgatgatacacgttttcctatgtaacaaacctacacatcctgcatgtgtaccttgggacataaaataaaagttgaaaagaaaaaaaaagaaaagaaaagggcatggaaagatccccaaacacaatagcaactgtgaaaataaagcagcccagaaattagcttaacaatacatgtatggaaactatatgaaaaactataaaattttactgtgagttataaataaatgaatacaagaaatacagacatatcatgctcatgattgagattactctgtgttattaggatatgtttcttttcaaaggaaagatgatatatttatttaaagtaatgtcaatcaaaatctcaatggacctcttttaggagatgtgcccaaattattttgaagcttatctggaaaaataagtagagataattcctgcctgtcctcctggggagatgcaggactgggctgggtaaggaggctgtagatggcagtaaggtaagtacacaggctcgtggcagaggatgggccaccactggagtcttgtagtctctgagttttcaaagtggtccagggaaacttctgacaacacttgggcatttcccactgaggtggatgagtatatttcagtcattcaacaaatactctttaagcattaagcatgattctaggaagtggagatggaacagtgaacaaaacaaagtcccaccctgggactatttgttctattgggactggttctatttgggaaggaagacaataaacttgaattttgtcgactaattcttaatacttataagggaaacctagagacagctatcaagaccctaatgtagtaaactagtgctttataaactgttggtcatgaaggcctaattgttttactttctaatacaggcacacagatatttttgaacatatgaaatcttttgcttggatgatgtggcaatattaaagtttctacacacagtcaattttggttcttatctcattgctgactgctaattaacaatttgtgattggtaggtccttggactacactttaggtaacactgaaataaataatctcagggacaatctcagcaatgggatatagtgctacagacaagctacttttgaaagggagttggctctgggaatcaattttccttcattctattggcacttcatcattgctctcctccattcatacaagagcactccaatttttaaaagtttcagcctttctactcttaaacatttcagcctttctctcttaaaaattggtctctatggcagcagaataaggggaaccagcagtggcaagttagtcttgcagaagagaaggagttcagacttcagacttgaccattctttgtcaaaccttgaagctctgcccactagctctgtgctaatggatgctttgggaagacttcattccatgggaaatggagtttactggaacagaatatggataatcttctaaaagaaagaaagagacaaaagcagggatgatcacagagtgtttcctgtctctatacactgagacatattgggaatttcagtttctgaagatccaagaaataataaaaggcctaatttcccatcttaatttcaggttcagttttttcctaattcccaggtctctcaggctctcaggcatgcacagggcctcgttcaagttatgtcagaagaaatcgctattcacttcaaagaaagttcaaacttctctaagcattagtttttctgatcgtagatataaataattgtctacaccttttacagctgtttagagttttagaactaatgcttatagatcctcttagcacaggttcagtgatattctaagtgctcccttaatgttagtttttaccttggaagggaaagttggataggtggttacttgtttgtatgtatggtttacttctatgtccaggcttccatgtatacattcagaaaatacttccttgattctttttcgctatttgttttttacacaaaaacgaagaggcacgctgttatatgattattactatgggtttagttaacacactttgaattagatgttgtggaccccacatttctttttttttagtgacttgcactcagagagtttggttagaaagtcactttggtcttgagggagataaacaacacatccccaaagggcaacctggagttgccctttgatgtgatagttgccctttgatgtgatagttaaccacatcagttagtgaagtgagtgaggggaggggtagtttgatgagctagctcccgcaaggagacaaggtatccccccacattaacctcatgctttgtgtcccaaatcaggacaactttgactcatttcagtctttattcctaggcagaagcaagtcttagtccatgccagtttatcccttgatctgaaaatagtctctggctgtcagacacaactatgtctgaaattaagattaagccctatgagtcttcagtgaacaaaatggaaataaatgctgaaaatccccctacctatcttgaaagcataccctggagtgagaggttgttttctcaattaaaatttatcttttcaggtgttttgtagaagtctaaagactcagtcagtgggcatgagtcatctggctgtggtaagattagaaattcctaacacatgatataggaggccagtgctccaggaggcagagaaaatgaaggaaaacagctttctacagctcttacccccacaacccccatctctctgtaacttaatttttcttctcaagtttcgaacaagtacagatagaacaacttgttttctaatctttttctctttttctcattcctcttctttctttattcttcttttcccccctctttttgtttccttttcctgactcttgaaaaccatggcaagtgcttattatttcagttgaatatgttaaaaattgttatcaagaagttgattttttgtgtataaaaatggtgaactaagatactgttaaaagagtggaataaatgaagaggagagacagaagaaccaaagatgggaaaaggactggaaaagaaaaagagactaaaaggaaggtaaggggcgaggaggaaatgggcctctgagcctgtagagaccaatggggactacggaagtctgagtttatttaaaagactaactggggaacatactttgctaagttgtgctttttcactagctaatatcataactaaaaaaccaaaggtattgcagcttctatttcaggaaatcgcaatccaactattcaatttttttttcagctgttttgatgttaaaagataggccagagcacaggttttgtgcatttgaaattgctaagtagctggccccacgggttattcactcacagtgctcttcaggtgactggtcagtgttggtgaggataatgtttccattgctccttcagtctctttggcctgctttcctgaaggagagtaatacaaatcctaattaaaatgaaaatgagaagttactaaaatgccctttcctttacagaactctatttcatttacagaggtcggatgttcgtgtttaactaccaaatccctctatctcacttagagctcaggagtcaaataatctagacaaataagtcaatgtagttcctaaaagtgccgaagtacttttctgccataattttttttttttttttttttttactttgaggacatctagcggcggtttagtggctgtgttcttcaaaggcaaactggaagaaacttcaggacatagtagcaatggcagaacctatttttctgaacaccttcacacttacagtgatttatcttaagcctgaagacaaaactgctgtggtcctggaggataaacaggctcattccagaatctgcagctaaatcctcacttccttctttcactgttatcagacaaaattcccttggcctaattgttttatgggtagtttttaatgagctcgttgtttattgacacaaatagatctccttttaaagactacagaatggccacaatcatgtcatttcatcaactaattaacagatattgatagcctgctttgggtggatattttgagggtcatactaagataagacaaaggtttacgtgaaagggaacttttgacctctttattctgtttgggcttgaattttattgggtagcatcttcatcggtggaaagagggcaggtctttttcaaatgctggtggtgaaagacttcagttctgtcctcagagacgagggcctaataatctgagttttcctttcctcatttgtaaatgaaggtgattatacttagttcataaggtggttgtgatgatgatatgaaacctgaagacaactcacatagtgtctagtatctggaagacactaaaaaatttttaaaaccccttgtctactcccctcacttcaccccatgccttcgacatggcccttgctgtagtggtcttctgggcaaaagtgttcactgcctcacccagagccctgcaaatgccactctgatccatcttcatctgagtctttggagcaaaccacatctcacagctttgtaattctgatctactgacttgccctggatctttcatacaaacctgttctataagatcaaggtaaatcacacaaaataacttgttaggcagagtttctgatagttatgataagcagcatcaaaactggctattttagcagtaaattccctgataatcatgggttcaagaagtgacatgttcagcttgttgacatgggagctgttgatatctatatttttcatttaatgtaaatttagacaaggtgatttctaagatcctcactgcatgtaacaaagttcaaacattttaattcagtctcaaagagccactctagtctactcacttctttagatttatcttaggtcactgttgccttgctcattatattcctacccattcatttaaaaaactctttttgaactcactgagctctttgctaccttttgacactagacataagttttcttctttttggactccatgttttattcttcatctggctaattccttcctattcatcctttggcatcagcataaatattgctttatcagagagattatttctgaccctaatctaaatttggtctcttcctttattctctctccttatactcctccttcctattataatttctaaacatgtgtttgtgattttatttgttcatttattgtctgtgtcctcactagaaatgtatactcaatgagaatagggacatatctgcattatttccaatgtctagcaaggtgcctggttcatgcagggcattcagtatcaaatggctgaaactcaacccttctaataaaaaagtcaatggccctatgactcatttctacactttaacacactccacatttcccttgacaaaacttttgttttgcttagtagccctctggggaatccccttgcctcagattatttttggttactgacggtttcaattcagcaaatcttgatttataagaaagatttcttaaaataatcttcatttttctccattcaaaaaattatttttcttcttaaacaggcaattcagtgtaggtttttaacatatcttttgtgcaaacttataatagttcaaatcccattggtacaaattccctcacaacagatatctttgcacaatgaaaagattttttcaagccctcagtttgtgggctgagaacgactaaaaagttgaagtctgttctctagattcttgtcagtgaataatgtgcagttccatagaccttattcttgacatgtgactaagccttacctactagtgaactattaaggaaggtattaaggagtgctaaaatgtggtattcgtaagcaccagagtattaatcaagcttcatgaggatttgaatttctccttcttttaccgtattaggctggcacaatgtcttggcaattgtaaaactcccaggtaattgaaatttccaggactacctatttgataatcattatagcatggttttaaaattggttttgtatatgtgattaatattgctttttcaaaattggaattgctgttcatttagcttgattcttttcaatttaactggtgaattgtttggttaacctttcccagatccttccagtcagaagtaatttctcttatttctgaactcttatagttctttgtaataccattttagtagcctttatcaaaacctgtctttcagatatttggctatgtcattcagctcccatttttggacctcttctgctttctggattgtctttctccattaaaaaaacaatctagttaattcctaactgctttactctgcaaacctctaattctcacttatcctttaaggtttagcttaggcaacccactggttgcctaagtctctcccacttcctcatcctcatcttcattgcacacttatattactctgtgtatgactctgttgtaacacttaccatgctaaactgtcaatttatttctccccaccagaccatgcttctcaaagtagcccacattttattagcactcagtatcattgccttaacacaatacatgtttaataaaattaatatgttttatttcctcaagtagacatgaaggtccttaagtttagagattatgttttattcagtcttatatttcattgtctactataatgtcttgtatagtacatgctttcaaaacttttgtgtaactctaagggaaaacccctacactctcctcttgtctctaagaaaatggggctataaatatatctctaactcaagttggtgggcatctgcagattgcatttctatttaagaaactctaggtatagaagtatcagtgagcccatttgccaggtatcttcagagaatgtttcttttgtaaattttaaatcaaaatagtgacttgggctgtctcaacagaagtgagaaatgagaaaatgcaggtggtgcactagatgaatctaattagatttagaatgagaaactagttttgaaagcccctgtagtcattgcctgtctagtatttcttctattgtgtgtagtagtatccacaaaacaaagatatcttgatgtgtgtttggttgatgtaagaaagtatcctcacatattgcaaaaaggagattttgagctgattacattataataacttttgtaaatcttgttatgttttcacataatccttattatttatttccatgtttctttgttatttttatagcccacctttggtgggatctgaaatgctcttacaatataaacatacatgtctattgaaaaaagcaatatccagagattcttagggtcaaacactaaattcttagtgtaaaaataatcattctcttgagttttgacccattctattttttcaaaatctgagactttactctcacttagtctgccttcttcagtccttatagaaaaaccaattatggatgtctatgggtagtgaagataaggctgcagaaatgaagtaaggtgttctcaagggaaattgagactttatgagaaatttagagaaattttacacaggaacaatttgaactaacaattttttaaaagtcaaatatttctgggagaattaggtgtcaaggtaggtgtgtgtgtgtgtgtgtgcgtgcatgtacatatgagtgtggtttggctgcattagaactcttctttattttaatgccaatttgctcaaacgcaaacacacatacatacatgtgcatgtatagtttttattacctagctgaatttagccagtttgaaagaacggctatttaggctggaggtctgggcggcagatgggaaggataatgaggaaggcaagcctgactgggtggtccatcattctgagggcctttgaggatggaaggttcatgaaaaacagtaagtgtagtagttaaaaagtattagaaatacactgctgcacttaccagctgtgtgactttgggtaagttgtttaatctccctgggcctcaatttcagttttctcatttgtaagatgtaaataataataggcctctctcatagggttgttgtgttaattaaaggagattgatacatataaaatgcttaggacataagcactcaatatatattagcttctgtcctcctcttctttctcttcttcctttttctcttctttttctccccttcttttggttctttctttgtttcctggtagaaggaatacaagactgtatcagaagatgcaagaaacatcagaaagtaaactctggcagatacaagagataattcctctggaactgtggtcttttgtcatacttctgtgtctgccctgtcaatcaccctctgtcctggcaaagaggaggctgcgagaaccatagagttctccactctgagactcttggcctcaagtaaccactgagtccttggtcactttaaggtatacagagaagttctggcagaaatttttctcatactagggctgaaagatgaaagtgattacctctgaggcagctggttctctagacttccccaccgtaaataaacttctggttgtaagcattagtgagcttgctccactatagaacatgtatatggagagagaagggtgtcagttcccatttgtccacaaattgagaatttatgcatctttggtgactgcctcccatttcagtccacagcatttaaactccagcgaaaatagatgcaaccggtgatgttgagctcacaatgtgccaggcactgttctaagtgcattctgtgtattaatttcgtttatccttacaactaccaaatgtgagagatactattattatcccagtttaacaaatgtgaaaaccaaatcacagagaagtgaaatagcagagtcaggactaggcccatctgacttcagaacgtacctctgaactattgccatctctcagcgccccctgccgtattcagctcttcgaaggctctcattctgtgcttaaaagctatcacaagattgtttattctgcaagctatgctttttctctttaatcttcacttggacacctattattactaaaaatcatttcagtcaataagcacctaatatattccattttatttgattccttatttctcttccccacaataatgttatgttttatttcctgtccttagtccattgtacattgcctggtacaaaggaggtgctcagtaaggtctatggaatgaaataaaaaaattatatattgggttgaatatacaatttattcatttttgaattcattttttcagaatacgattgtatagacaggtccaactatagaaggttgccataaactttgaagtttacaataaatttaaatgcgttcacagcttctagttaggcagaagaggctaataattctacaggtggtagcttgcttttctaaggaaaagaagaaaccagcagtacaattatgctgatttctgccatttaatggtgtgttttttgattgtttgacactaggtggagccaagaagccttgcagggaaactccaaagaagcaggaactactgttaccaaccctctgatcgtactcaaaataatttgaagttgttttttttttttttttttttaaagattgcaaactggtgcattattcgcatcaattatttaattacattcattctccagtgaattatttgctctactggttaccttattatttttgaagtggaaaagttttatactttatttctttcagtttcccaacacttagaaacaattttaaatatttaagtgaaatctctatttggtagttgagactcaaaaccccaaatctttcttcaccctcccaccctcaccctcctttcttttaagtgcaatgtggttgcagacgccgaaggtctggcattctgtgaaaaaaggtcctggactagcagtgaggaagttttctttttcttctctttcctttttctttttttgttttaaaaataatttttgtacattaaaacagtgaatatcagcaactgcaattggttcaacataaccaattttacacttaccaagttcacatgaaagtcaaaagcagaatcataaccataatagttttgactctgcttttgactttccttatgactttggtaggtcacctgtcttcttggggtctcattttcttcatccattaaatggaaggaacaggcaccaacttgaaagacacattttcatttgaatttttcataattttggcccctgaattattctgatctgtgtcattgactggttctttatgcttttgtccagcatgtgtttttgaattctatagattttggctaattatggactattactagatgttcattaattacagactactggagacctgaaatgtgtcctctacataggctcaagttcattgttaatttcctgacataatttcttacaggatgccgagttactgttaattgtatttagttcaattaaaggaaaacaataatagaaattcatgttttattacagtgttaccttaggtttttccctttataattagcttagtgaggtagctctatttctgtaaagtagtgttgatttctttccagaggggtattttactctagtaccatgtaatagttaagttgaaccaaaccttaactgggaaagttaaactaaatcttaatcttcattttatccttcaccctgggtgggatgtcagaataaatcagttttaataacttttccaaacatcagtgttcatagcaattaatagatggttctgtaccattttcatatggtactatatttagttggtaaaaaccagatgatgattttccaatggctaaactgtaggtattttaaaataagagtattatcatttgctagaccaataatttccccaataaattcagtagcatacaaatcctaaaaaaactccctaaggaaattattttatgattaaatagcttaggtaacatcgcatattatatatgggggttcacaatgaatagcatagtaaaggctatgagaaggcctgcagttatgtttcttttttaactttcacctggtattctcaaatttttatgaccttttctctataatactgtgcagagcttgatatccatgagccatatctgatacatattttctcttattcttaaaattttttcaaggcagtcatttatattaaattactatattagctagcatcaatattttacctctggaacaaaaaaagagcattcaaaatttaatacctctttgattttctttacttagtagtaaataaaagtgaaattgtagttggaaattgtactttgaaattggagtttcttccattttgaaggagattttcctgcccatagtcctttactaacagtggatcaggtagatgtgttttttagtctaaacatgatggaggaaggtgcacaattttggaccaaaaccatgatataatttccccatatttctcatttccctgatgctaaaactgttctctttatatcaattgaaatgggtcttattactagctaagatctcttgaattcaaatactgactttctgctgtgcacctttttgcaagcttactaaccaatctatgcctcgttttcctcatctgtaaaatggatatattagtatctatgttaagaggttgttgtgaggaccaggtaagtgaacactcataatgcacttggagcactgattggaaagcctttcatcatgtcagctgttatggttaatgcttatggtgctatgcctaggtggcaacggagaatgtcacgcattagcctttccccaacgccctcatcaatagaatgtaaaatttttaaagaaatagataaaacttgagctctgttttgccaaggcaagaatttccagatcatattgtgttatttgatcaaaattctattttgccttccatctatatccttaacattagtcaattagttatccatttgttgatctcatatattaactgagtgcatgttgttttataggcactgggctaattttgtagtaatgatattggacaagttagatatggctcctctccttgtagacctcagagttatagagggactcgcaaagagcgtactgggtactgtgagagaggaattcatgagagtagacagagttagccacctccaaatagggaattatggaattttcatggagaaaaataacattaaggtcgaagtcttttttctttttaatgccttcatttcttcatatttacttacttattttcaacttctattttagattcaagggctacatgtgcaggtttgtcacctgggtatgtggtgtgacatttggggtacaaattatcccattacccaggtattgaacaatatttacccctctccctctgttccccctctagtagtctccaatgtctgttgttgccatctttatgtctgagtacccaatgtttagttcccacttataagtgagaatatgtggtatttgggtttttgttactgtgttaatttgcttaggataatggccccagctgtattcatgttgctgcaaaggacatgatttaatttttttttatggttgcatagtataccatgatgtgtatgtaccacatttgctttatccaatctgccattgatggacacctaggttaattccatgtctttttttttttttttttttttttactgtgaatagtgctgtgatgaacatgcaagtgcgtaggtcttttggcaaaataacttgttttcttttgagtatatacacagcaatgggattgctggattgaatggtaattctaagttctttgagtaatctccaaactgttttccatagtggctgagctaatttatattgccaccaacagtgtataagcattcccttttctccagcctctgttgttttctgactttctaataatagtcattctgagtggtgtgtgatggtatctcattgtggttttgatttttcatttctctgatgattactgatgtggagcactttttcatgcttgtttggccacttgtatgtcttcttttgggaagtgtctgttcatatcctttgcccatttttaatggagttatttgctttttgcttgttgaattgcttagattttttatagattgtggctatcagacctttttttggatgcacagcaaatattttctaccattctgtaggttgtctgcttactctgttgatagtttcttttgcagtgcagaagatctttcatttaattaggtcccaactgtcgattttttttgcatttgtttttgaggatttagtcataaattactttccaaagtagatgtccagaatggtgttttctaggttttcttctaggatgattacagtttgatatcttacatttaaatctttaatccatcttgagttaatttttgcatatgcagaaggtagggatccagtttcattcttcttcacatggctcaccagctatctcagcaccatctattgaatagagagtcttttctttattgcttatttttgtcaactttgtcagcgattagatggttgtaggtatgtggctttatttccaggtcctctattctgttccattggtctacatgtctgtttttgtactagtaccttgctactttgtttattgtaacccaatagtatagttaagttgggtaatgtaatgcctctggctttgttctttttgcttaggattgctttgactattcaggctcttttttggttccatatgaattctggcattttttcccccaattctgtgaaaaaatgatgttggtagtttaataggaaaagcattaaatttgtagattgctttgggcaatatgaccatttttatgatattggttcctccaatccatgagcatgaaatgtttttccatttgtttgtgtcatctattatttcttttagcagtgttttatggctctccttagttagatgtattcctaagtattttatcattttttgactattgtaaatgggattatattcttgatttggctctcagcttgaagattattggtgtatagaatgctactgatttttgtacacactgagtttgtttcctggaaccttaaaattgcttatcagttttaacagccttttggcagagtattagggttttctgagaatagaatcacatcatcaacaaagggagatagtttgacttttttcttttcctatttgaatgccttttatttatttctcttgcatgattgcactggctagcattttcagtactatgttgaataggaatggtgacactgggcattcttgtcttgttccagttctcaaggaggatgcttccagcttttgctcattcagtgtgatgttggctgttggtttgtcatagatggctctcattatttttgaggtaggttccttcagtgcctaacttcttgagagttattataatgaatgtatgttgaattttatgtaagctttttccaagttcattgagatgatctttgtgtgtgtgtatgttaacttctgttaatttggtgaatctcatttattgatatgcacatgttgaaacaaccttgcattctgggaatgaagcctacttgatcatcgtggattaactttctgatatattgttgaatttggtttgctatgattttgttgaggattcttgtgtctatttttctcaggggtattggcctgtagttttcttttttagctgtgtccttgccaggttttggtatcagagtgatactggtttcatagcatgacttacggagaagtcctttctctttaattttttgggatagttccagtagaattggtactagcttttctttgtacatctggtagaatttggctataaagtcatctgctttggggctttctgtggttggtaggttttattactaattcaatatcaaaacttgatattagtctattcagtgtttcaactgtttcccgattaaatcttggaaggttttgtgcttccaggagtttatccatttcctgtaaattttctagtatgtatcctcatagtccctgtattagttcattctcacattgctataaatacctaaaactatgtaatttatttaaaaaaggaggtttaattggctcatggttccacaggctgaaaaggaagcatgatgctggcatctgcttggtttctggggaaacctcaggaaacctttactcatagtggaaggcacacggagatccagcacttcacatggccagaacaggagaaagagaaagaggggaaggtgccacaaagttttaaataaccagatctcatgtaaactcactcaatccctttcatgagaacaggaccaggagatagggctaatatttcatgggaactccacccccatgatccaatcacctcccagcaggctccacctccaacactagggattataattcgacataagatttgaatggggacacagatccaaactgtatcattctgcccctggcacctcccaaatctaatgttcttctcacgttgcaaaatacaatcatgcctttctaacagtcctccaaagtcttaagtcattccagcattaacccaaaagtccaaagttccaagtctaatctgagacaaggcaagtcccttctacctataagactgtaaaatcaaagaacaaggtatttctccaagatacaatggggctacatgcattgggtaaataatcctgttccaaaagggagaaattggccaaaagaaagggtctctaggcaccgtgcaagtctaaaacccagcagggcattcattaaattttaaaccttcaaaataatcttctttgaatccatgtctcacatccaggacatattggtgcaaggggtaggctctcaaagcctactcaggtccatcactgtggctttgcagggttcagtcctcacagctgctctcatgggctggtgttgagtgcctgtggctcttccagattggggatacaagctgccagtggatctaccatttgtgagtctggaggacaatggctctcttctcatagctccactaggcagtgccccagtggagattctctgcgagggcttcaacacagatttcttctcctcattgccccagtagaggctctctatgagggatccaaccctgcagcaggcttctgtctggaactccaggcttttccatacatcctctgaaatctaggcagtggcttctaagcctcaactcttgcattctgtgtacctgcaggtttaacaccacatggaaaccaccaaggcttatgtcttgcaccctctggagcagcgatctgagctgtacgtgggcccctttgagccatcgctggagctgaagtggctgggatgcagggctcagtgtccgaaggctgtgcagggcagcatggctctgggcttggcccacaaaaccatttttccctttggggcctctgcaactgtagtaggaggggctactgttaaagtctctgaaatgccttctgggccctttcttcattgtcttgactattagtacttggctcatttttacttatgcaactttcttcagcctgcttgaatttctcccctgaaaatgggctcttcttttctatcacatggctgggctacaaattttccaaattttatgctctgcttcccttttaaatataagttccagttttatgacacttctttactcatgcatataagcataggctgttagaagcagccaggtcacattttgaaagcttttctccttagaaatttattctgccatattccatgaatcatcatctgtcaaagttccacatatccctagatcaggggcacaatacagccaatctctttgctactacataacaaaagtgacctttgctccagttcccaataagtgcctcatctccctctgagagatcctcagcctggacttcattgtccatatcaccatcagcattttggtcacaacaatttaataagtctctagtaagtttcaaactttctctcatcttcctgtcttcttctgagccctccacagtcttccaacctttgccagttactcaattccaaaggtgcatccacattttcaggtatctttatggcaatgccccactacttggtactaattttctgtattagtccattcttgccttgctataaataaatgcctgaaagtgggtaatttataaagaaaagaggtttaattggttcatagttcttcaggctttacaggaagcatgatgcgggcatcttctcagcttctggggagacctctggaaacctttactcatggtggaaggtgaagggggagccagcacttcaaatggctggagcaggagaaagagagagatgggggaggtgccacacacttttaaataaccagatcttacaataactcactcactatcatgagaacagcaccaggaaatgataccaaagtattcattagaactttgaccccatgatcaaatcacctcccaccaggcccaccttcaaacttgaagatcataattcaacacgagttttgtattgggacagatatataagccatatcaatcactgaggatcttttgtatttctgtgagattggtagtaatatcacttttgttgtttttgattatgcttatttggatcttctttctttttttgtgatataaaattgtttattaggagcatgacaatttatattacctggaaagtaggaatggatttttaatacagtttaaattaatgcatcaggagtagctgaaggcacaaattaaaaatcacttgcttttttatacttaaaatatagaaaaagaagaaaaactttaattttaaaaagtactctgataatccatagacttcatgttgtactttttaaaagaaaatctgattaaaaaaacatatttacccttgttgaacatccacaataataatgtttgaaaaaaaacttacctcttaaggctattagacacagggaaagcattgtgaatatacaaatattttagttccaaaactaaactctgccacgtgtatacctatgtaacaatactgcacattctgcacatgtaccccagaacttaaagtataataataataaaagatcccaaggagtaaagcaggtgaattggtttaaatgcctgaatcttgatgactcttttatccattttacatagcatccaaaacatgtcagtgttgtgaattcctttgctaatctttttttgaatttcccagtgaaaaacataccaaagaaacaaaattcaatttacaactagctgcagagagccatggatgtgaccagttatgttaaaattcctgcccacttccactgcgtgcacaggccatccagctgcccctcgtcgcacccaattgtcccagtgatggtgtttccgtggctatcactaccacttctctgcccctgcagcctgttagacaaacaccctttgctgtttctgactaagagtgcttgcagatccacataattatccttgtcgctccaaatcccaaggatttgaccactagctaaaatggccatttacctgttttcataaatcttttttctagttttattatttataatggttttttgtattgttacagccgccaccccttcctccacaatgcacatccttttcctgttagcttttctctaagtctcccttaaatctcagctaacaagatctcctatatatgattagccattccttttctttgaatgttctttaagacagacaaacccctgggatgacatacagttggttaaaagtacatcatcaggtaatcataacacagccatcaactgttaagaaataccagaggctaaaaaaaaatcctgcttttcagacccagtaaactaagaactatcttacagtagcacagaattaccagatgttaagcctcaggtaattgctagaggaggttttccaaatcagaaaccttggggacctcatcaaatttgccaggatatctcagttgctccattctgcctggtgtatccctaagaaaaaaaattaaatagtgtctttctttgttaatctagctagctgtcaatcaatcttgtttatcctttcaaatcatcaacttttggttttattgatttttttatatggagtttttgggtctctcttttattcagttcagctctgattttagttatttattttcttctgctgtctttggggttagttcttgttttcctcgttactctgggtgcagtgttacatcattaatttgtgatctttctaacttcttgaggttgacatttagtgttatgaactttcctcttaacactgcttttgctgtatcccagaaatttttgtatgttgtgtccctgtttttctctattacaaagaatttttaaatttctttcttgatttcattgtctacccaaaagttattcaggaacaagttgtttaatttccaagaaattatgtggtttttgagacatcctagtattaatttctattttcattccactgtggtctgatagtataattttaatttttttgaatttattgagatttgccttatggtagagcgtgtagtcagtcttagagtatattctgtgtgctaatgaatatattctggggttgataggtgtagtatactgtagatgtctattaagtttataaatatggatgctcaaatattggatgcctatatatttagtatagttatgtgttctcattgaattaaatccttttatctttatggaatgcccttctttgttcttctttacagttgttggttgaaagtctgttttttactataagaatagcaacctctgctattttttgttttctatttgtgcagccaatctttctccaaccgtttactttgagcgtagggtgttatgtgtgagatgggtctcttgaatacagcagattaatggatttttttttttaattcaacttgctactctgtgtcttttaagtcaggtgtttaggccatttacattcaaggttaatattggtatgtgaggttttgatcttattatgaagttgttacctggttgctttatagggtcacatattgtgtgatcattttatagggtttgcagaatatgtatttatgtgtatttttgtggtagcagatattgttatttcatttccatatttagacttctcttaaaaatctcttgtattgctggtgtagtgctaatgaattcccttagtccttgcttgtctggaaaatatcttatttctccttctcttacgaagcttagttaggcagaatgtgaaattcttagatggaattattttttctttaagaatgctgaaaacaggcccccaatgtttcctggcttgtaatgtttctgctgagaagtctgctgttagcccaacagggttccctttgtgcatgatcttccctttttctctagctgcctttaagattttttcttcagtgttgatcttggacagactggtggctgtatgccttggtgatgttgattttgcatagtatcttacagatgttctatcagtttcttgtatctggatttttacctgtctagcaaggttaagaaagtttcttgaattattccctcaaatatatttcctattattgaatgccaaataatttgtatgtttgtttgctttgaatgattacatatttctcaagtactttgttcattttttaaaaattcttctttttttaattcttgtctcactgtgtcagctcagaaaaacagtcttcaagctctaaattttttttcttctgcttgatacagtctgttgataccgctttcagttgtattttgaagtttcttaggtgagtttttcaattccagaatctctaattgacttctttatctcttccttcattttctagattgctttataaatttctttgtgttgattttcaacgttgtcttggatctcattaaccttccttgcaatccatgctttgacttctttatgtgtcatttctgaatttccattttggttagggaccattgctggagagctgatgtggtctttttgtggtgtcactcctttcatatttttcatgctggcagaattcttatgctggttccttctcatatggagacactagctctttaaatttttgtaatatttttgtgtgggtagagttttttcttcttcttgctttctctataatgttaatattattataatttttattctttccttttcccttttccctccattttggggggatgtgactgtagagaatgttggatagggtcttctggctttgctttcatagccttattcatttactttggctgattttatattgggctgtggagttcaacctacaagctattgatggcatttacaggtaagagctggctgtggccaacgtgtctgggtatatacttgattcttatttactggcagaaactccctattgcctaagacaataggctgattcatggcgtgtacagtggtctgagctccctgaccagccccagagcagcaaagaccataaagggtcaggggatgactgggcaggtccacctattggtctcctgatggcaggcgaaggcaccagcaccaagggagagtcctgtgagcagccaccaaatactcacaggtgtgcctagggatggagctggaacagtgcttcagctccaggttctctgcacaaaattggaggatggcctaagcttctaatccagaagggtaagcactctaagtgcctggagctctgtataggcatggagcagagaggatcccctgaaccaagatctctgaacaggagggttgggtgacagactgattaaccaggcatgcatgtgctttgaatttctggagatctgtttgggcctgaagcagagagggacttgctgcaccatgatctatgtccaaggagggtggggtggctcaggctgttgaaccagatgagtggttgctccaaatgcctggcattctgcctgggtatgaagcagagagattatccctgtaccaggatctctgcacaggaagggtggggcaggtcaggttgctgatccagatgaatggtgccctgaatgcctggatatctgcttgtgcaggtgctcctaatgcctagagatctgcctgagcatgtagtagagaggtgtgccaggatatctgcacaggaaaagtgggacagcttagcctgctaatccaggtgagctggtgctctgaacacctggagatctgtgagggtggggcacagagaaagccctactgtaccaagatctaggtccaggaagggtgaggcagttcaggctgctgaaccaagtaaatgagtgctttaaatgcctggagacagatacctgcctgggcatggagaagagaaaactccacttcattgcagtctatgtccaggaagggtagggtggctcagtctgctgaacaagtcaaacaggtgctctgaattcttaaatatctgcttgggtgtggagaagacagagcctctctgcaacatgatctatttccaggaagggtggggcagctcaagctgctggtccagggaagtgaatgctccaaatgcctggatttcagcctaggggtggaacagagagggccccccaatgagctacaatctcaggagagcagggtagggaatccagcaatggcacatatcaatcagttccaggttgtcaagctggccctggcagcaaatcttgccacttaggagaaattacagctgtagcaggtctcctcctgccccagggttgtgataggggaaaaacacaatttttgccttactgctgaggcattttccagagttctggctgtggaggcccttaccacactgagagcgggtgctccctggcctgagactaaaatgcctgtgtagccacactgctgtgtcgacaaagaatggctgactttgtacacattcagattaaaaatggcatcctgctctcacttctgggtctggactgagaccctggactgaaagtgtatgcaagttttcatggtatctttctttacagcatctctaagcctctcagcctcttcccaagttagctccagggtgtgggagacacaaagtgctttccctcagcctgggttgctcagatccacagtggaaaggtgagttccagagggaggctgtcttcctctctcacatgctggagcttaagtcacttttatcaactgaacaccacagaggctgtttgctggtgttctgctctctgggatctgaatgagaagaagtaagtcatgttcaaagaattgagagaaattctacatatcctaaagatagaatgtaagtttgaaagtaatgtgtgtgtgtgataagaataaagctagatatacaatttttcacattaattaggcctttagtgaactataggtaaagtgatcatctgacaactgttatgtattcatggccaggcaggagattctcatcagaatccttttaaggcagaaggatgcaacattttgaagacaatttttttccaattttttttgtagtaaagtacacatagcataaaatttaccatcttaatcattttaagtctacagtttagtggtactaaatacacccacagtgttgtacaataattactaccatccatgtgataactcatcttgtaaaactgaaactctgtatccattaaaaatcactcccacttctaccctactctgctcaacttgctcacataggagacttaagccctaggagaactgttggtcctgaactctgcagggtggtatgacccatcagataacttggtctgacctgagcaccccttggtcttctggcctgtcctaggaacaaagtctgaccatgcttgccttcaaggcagcctcagaagccctgggggcctgcatcatagcttctgcactgatggactgtgcctgaacagtgaagaacttcagcagggtgtcccccatggctatgcaccagcccacacacttcttcaccccactgcagcttcttctgggcccatggcaactccacatcactttgctcgcacatgtctgcgtgggtgacttttgctttccttgctctgccagcatgtgactgtttgtgcaccctgccttgccactgctacaataggatgaagcccatcccctcacccctgccaacagccatagcaagcagagcccctttgtctaccaccataattggatgcttcttgaggcctctgagaagtagaggttgctatgcttactgtacagcctggagaaccatgagccaattaaacctcttttcttataaattacccagtctcaggtactttttgtagcagtgcaagaatagcctagcataaaattgatactaacagtggggaatcactacaaagatgcttgaaaatgtggaagcaggtttggaactgggtaacaggcagaagttgtaagagtttggagggctcaaaagaagacacaaagatcagggaacgtttaaaacttcttagagactggttaaatggttatgaccaaaatgctgatagtgatgtgaacagtgaattccaggttgccgaggtctcagatggaaatgaggaacttattgggaactgaagctcaggtcatgcatgttatgttttagcaaatagtttggctgcattctgttcatgccctagggatctgtggaagtgtgaacttcatagtgacagagtatgtggcagaagaaatttctaagcaacaaattgtttatgatgtgtcctggctgctcctaacagcctgtacacagacacatgagcaaaggaatgacttacatttggaagttatattttaaaaagaagcagagcaaaaatatttggaaaatttacagcctgtccgtggggcagagaaagaaaaagcttttaattcaagcaggctgtggagcaatttcttgctagagaatttgcccaactaaatgggagccaagtgctaatatccaagacagtgggagaagaccttgaagatattttagaggtcttcgcagcagcccctcccatcacaggtccagaggcctagaagagaagaatggcttcatgcgcctggctcaggaccctgcttccctttacagcatcaagacacagctcaccacatcttagctactcagtctccagcctcatctcaaaggggcccaggtacagctctggacacagttccagaaggtgcaagctataagccttggcagcttccacatggtgttaagcctgtgagtgcacaatgtgcaagagttgaggcttgggagcctctgcctagatttcagaggatgtatggaaaagcctgggtgaccaggcagaaggctattgcaagattggagcccccacagagaacctctactaaggcattgccaagggaaactttgggtttgagctcacatacagagtcctcactggggcactgcctagtggagttgtgagaagaaagccactatccttcagaccccagaatggtagatccaccggtggcttgcaccctcaacctggaaaagcaaccagcattcaacttcaacccactggagcaggcctaggggctgaaccctgaaaagccccaggaatggagctgcccaaatccttgggaacccaccctttgcatcagtatgccctggatatgggacattgaacaaaatgagattattttggagctttaagaatgaataatttccctgctgggttttgaaatttcatggggcctgtagcccctttcttttggctgatttcttccttttggaatgggaatatttactcaatgcctactcgcaatgtatattttaagtaaataacttgttttatttcacaggcttatagctggaagggacttaactcagacgagactttgaactttggacttttaagttaatgcaggggtgagtgaagactttgggggacttttggaaaggcatgattgtattttgcaatgtaagaaggtcatgagatttgggaggggccaggggcagaatgatgtagtttggatatttgtccacacccaaatctcatgtcaaattgtaatccccagtgccggaggtggggcctggtgggagatgtttggatcatgggaacagatccctcatggcttggtgctgtatttgtgatagtaagttctcatgagatctggtcattaaaaagtgtgtggcatctccttccgtgactctttttcactcttactcctgttattgccatgtgatgtgactgctcacctatgcctctcatcataattggaagcttcctgaggactccccagaagcagatggcattaagcttcctgtactgcctgcagaaccatgagccaattgtatctcttttcttataaattgcctagtctcaagtttttttttttatagcagtgcaagaatgacctgataaacttacttgttcacttttgcttatttttcttgaatgtttgaagtattattttaaaaacttttgctcacttgtcatttaaggcatttaaggtatgatttcttttagtattgtcagtttgggattttacatttaactctttaagtcagttttcaaatatgttcagaaatagaggtttagttttattcttatgaatgtggatatccaatttttgaatcatttattgaagagactgtatttccttcagtatatgttcttggaatctttgtaaaaaataatttcactgtaggtatgtgatttttatttctggtctctcttttgttccatggtccatgtgtccaattttatgttggtactatgctgtttggattattatacctttgtagtatagtaatgtgatgtcaccagcttttttgttgttgttgttgttgtcattttaggatttttttctatttctgtgaagaatttcatgtatattttgatatcaaatcaaatagggattccatgaaatctgtaaattgctttgggtagcatggtcatctaacaatattaattcttcccattcatgaatgtaagatatcttttcatttctctgtcttcaatttctttcatcaatattttatagtattcagtgtaaagatctttcacctccttgtttaagtttattcctaggtatcttatttacttatttattttgaaatctatttcaaatagaaatagatttcctattgaaattggaattattttcttgatttttttttcagattgtttgctactagtgtacagaaatgattctgatatttttatgttgatttaatattctgcaactttactgactttgtttattagttctgatagatatttgttgaaatctttagggtattatctctataagatcatgctatctgcaaacaggaacaatttgacttcctttttttccaattaggatttcttctatttctcctcttgtctaattgctctggcgaggacttcctctactatattgaatagaagtggtaatagtggacatcattttcttattcatgatcttagagagaaaccttcagctttttccattcagtgtgatattatctgtgggtttgtcatatacagtcattactttattgagataataccttctataccttattgagaatttttaaatgataaagcagtgttaaattttgtcaaatgctttttatatacgtattgaaatgatcatatggtctttgtctttcttctttttaatgtgatgtatcacattttttgtgtgtttatgttgaaccatctttgcattcctagatgaattccatttgatcatggtaaatgatctttttaatgagtggttgaattcagtttgctggtatattgttgagaatgtttgcatctgttcatcagggatattggcctgcagctttttcttgtgttgttgtgttctgatttatttttggaatcaggatattgcttgccttgtaacattagtttggaagtatttcttcttcaatttttttctgaaataatttgagaagaattattggattattattgaaatattattgaaataattggtattagatcttctttaaacgtttggtagaattcagcagtgaagctgtcaattcctaatttttttttttgtaggggagatggaagactttttgttatttattaaatttcctcacataatactcatttgttcagattttcaattttttaaaataattcaattttaataggttgtgtgtctctaggaatttatccatttcttctatgctttcaaatttattggtatatagtttatattagtctgctatgatcatttgtatttctgtgatgccagttttaatgttttctatttcatctctgattttatttatttgggtcttctcttccttttatttaaagttactgtatctaaagttctatcgtgttcatcttttcaaaaagaccactctttgttgagtttcttttttggttcctattttatgtatttccttttgtgctgtattgttttctttcttcaaacaattttgcatttaatttgttcttgacttcttagtttcttgatttgcaaagttaggttgtttattagaaatctttcttctttttgcatcaatattgctatgaatttcccttttaaaactgcttttgttatgtcccataggttttggcataatgtcttttcatccttgtctcaaaaacttttttaaacttatttttaatttatttattgatgtactgttcattcagaattatgttgtataatttccatgaaaacttttgtaaggtttcaaaaatttttattttattgatgtataataatgatttatggggatgtatgatattttgatatgtgcatacaatgtgcagtgattaaatccgggtaattgggatttccaccaccttaaatatttatttatttatttatgtttaaagtcttccaaatcttttttacgctattttgaaatattcaatgttattgttattacagttaccatactctgctattgaacactagaacttatttctttcatctgtttgtatttttgcaccccctaactgacctctgtttatccttcatcctcctacctttcccagacttgcagtcaccattctaccacctgccttaatgagataaacgttttaagctccaatatattagtgagaacatacaatatttgtcttgtttttcctggcttattttacttgcaatgtcctctagacttattcatgttgctgaaaatgaaagaattttattctatttatgaataaataatgttctatttcacatatataccacattttctttattcatcctttgatacacacttaagttgattccgtgtcttggccattgtgaatagtgctgtaatgaacatgggaatgcagatatctgttcaacataccgattttcttctttttggatatatatccagtagtgggatttctggattatttgatatttccattttttgttttttgagtattgtgaatatttcttgctattggtttctagttttatgccattatggtttgaaaaaaatacttgatatgatctatatcttcttaaatttgttaaaatttgttttttagtctaacatatgatatatcttggagactatttcatgtgcacttaagaagaaagggtatcctgcagctgttacatggaatgttctgtaaatgtatgttaggtcaattaggtctatggtatgggttaagtgcaatgtttctttgttgattttctgtctagactatcttccatagtggaaagcgaactgttgaagtcctctgctattattatattgcagtctatctctcactttagatttaatattttcttcatatattaggatgcctgatgtttggtatatatatatatttgcaactgatattttatcttactgaattatataataaccttgtcttttttttttttttttttttttttttttttttttacaatttttgccttaaagttttacctagtataaatatggctactcctcattttttatttccattttcatgaaatatcttcttcagtccattcactttcaatctgtttgtcttcaatggtgaggtgagtcttttgtagacaacatagagttgggtcttatttttttaatccattcagcaattctatatcttttaattgaaaatttagttcatttatattcaaggttcttattgataggtaatgacttactcctaccattttgttagtttttttggggtgctcttctgtagatcatttgctctttttttcctttcttgtttaactctgaggtttggtggttttctgtggtgctaatctttgtttcctctctgttcctcatttgtgtatctgctgtaatttctttcttcatggttactatgtggctaatataaaaatcttgtagctgttaagacattattttaggctgataataaactttggttgcataaaaatactcaggacttttctcccttaccactactttctgatttgggttgccttaatttactttatgttgtgtgtgttgcttagtcactaattggggttgttcttttttttcctttttgactttaaacttttatactagaggattgaaaggattttagcactgggatattctgattatgattatgtatttacctgcaatagttagctgtatactttcataatagtaattatggctttttgtttctagttgtagcattttcttaagcatttctcttaagaccagtctagtagtgacgaatttcctcagttttgcttgtctgagaaggcctttaattctccattactgaaggagagctttgctggatatagtattcttggctgacatttttttttttcttacagcactttgaatatatcattccactctctcctggcatataaagtttctgctgagaaatatgctgacagtctaatcatgattcctatgtggtgacattattctcttataactttaaagtttgtctctttatctttgacttttgacggtttgattacaatgtgcttcagagagattttctgcggggaggtgtgtctcattgggaatatttgaacttcctggatctgaatgtccatttctctcccaaggcttggtaatttttcaactattattttgctacataggttttatgtgtcttttccatttcttctttctcttgtacacctataatgcaaactgttttctacataatttgacgtcccataagtcctgtaatctttattctttcttcttcttatttttttccctctgaagagaatatttcaaaatactgtcttcaagttcagaaattctttcttctgtttagtctgctgttgatgtgttaaattgtatttttttttgttcttgaattctttagcttcaagaattctatttggttattttttatgatatctatttcttggttgaaatctcattcagattatgaattgttttcccaatttatagaactgtttttctttattcccttgtatcttactgatttttcttaacatcattgttttgaactcctttccagacatttcataaatagccttttctgttactgaagacttactgtcttcttttgggattgtcacattttcttgatttttaatgttttttttgtctttctacattgatatttgcacatctactcaaacagtcattttatctaattttttggagtcgttttcatagaaaaatactttttgtgtaggtgtgtcccaagattttgggtaagaatggtgtgttggctttggttctgggtggactcagtagtgtggactttctatagattcttcagctataatttgtatctgcaatgactgtgattgtcttactggtctaggctgtgggaatttgtaatgacaatggtacagtctcctatgcagatctgcctgtttctctgaaggataggatgcccattgggttcaggtgatgtggtcatctctttaggcctaggatctagatagctggattattggtgctgcaggtaccataatggcagggactcaggtatacaggcagtcagaggctactggctgcaagactcgaccctctctagctgtgggtcctgcttcaagatggctgcatgcctaagttattttttaaaacaaacaccttagtcctaaatttagtcatttgcaacaaatgtgcttactttattttaactgttgcataagatcaattcataataaagcccaagtgtctcctgaccatggtgtacaatcatactatgggaaatatagtcaaaataaaagtaacaattaatcttagttcttttcctggaacattattgtagagcttcctcttttatcatgttattttattctaaaatgttcttgcttgtattaacaatcttaactttttccagataattgtgccatagcaccacattctgtttaagtagtgagtctttgttatactgtaaaattggacatacgttttctgaatatgtcctgcaaaacatctgctcataactgcaacctcctggagaatgactcctgctcgattcttatggtgctatgaccccactctctaggtgtcttttccttggtttgttctgcattattttttaaatcatgcaatggtggtggaaaagttgtatattttattttgggttttagaaagaagagtgattttccaattaaacctaaattgtaaagggtcacttcattgtaacagtgccagtttattttcattaaacaaaatattggctgctatagctatgaatgatattataatccccaaatgcatttattctttcaatacatatgtaatgagtactttctgtgtgctaggcattgttctggtgcttaggatacatctgtgaataaaaatgtcaataacatctatttccgtatagcttattttctagttaggagagaaaaacaattcacaataaatcaaaaagttctacctgatagatctggattagtaggtatattgaagtatattttaatactagaaaataacaatatattagaaggttaaaatacatttggggtttaaaaatgatataaagcttgtccaattaagttattttttaatccttagaatcttcctgggtatgggtttccatatgtaaattctccaaattgtcttcctatattttgttttatttaaatcaggattcaatcaagccagttgctgatttggttatttcactgaagtatgttaaaagtctcctttaatctggtatagtgcctttatctcactcccttttcccatagtttgattgaaatgtcagttttcctatagattatttcactgtagcaagtactattttgctctatcatattcctgtggcattcactgttcccatgaataataacttagtggcttccaaaaaaatcgcaactgtcactttgcctttgagcttccttgcctttcctcaccatcagccatgccaacattcatgccttagttaacacttccctctgtcttcacccatcctcaacagtcttcaaccagtggttgataagagtaaataatctagatctctcattttcatttgggataactctgagatatattctactctgtatttcagagtcccttagtggaacttaacccaagtgacttgcagtagtacatatgctcaataatactcttgtagtggcttcattgtttttccatgcttacgttgctccctcagttctctgccagtgatatcccacgaataacctataaaccttttctcaaggttttattttgagggaatccgacctaagataccactgatctaaatttggtgaaataagtaattctcttaatatcatttattatattagtctgcttctatagactgaaagctagaataaaggcttttttagattccgtgttttttagggggaagggtcaaaaatgttttgtagttagtgctgagtatctcacattgcatcacaccaggaatcaaacaatgctggtagtctcacttttaatacatcagtaaattaagatggcaggagtgtgtgattccctactagccttatgcctaaaggttttaagattcattaatgaccattgccagaatcagttatttcattaaggattgtaaactgattattttcttaattctattatttcttcagcatacattacctgaaattcttctgcattgaatatgttttctctcatctactggtgacattttatcttataatacattttacaccaaaaggtaggataaatgctggaattatctaatatctgagtaaaagattataccctaacaacttaaaatcttgtccaataaattttatttctttttccttcttcactttccgccattcctactcgtctttctttctcttctctctcctctctacattctaatcctgttttttctccttgtacttttctattccttctccttctttatattattataaaccatgtcttttacataatcaacattttaaaatcatttttggatgttaatattggcccatatttggccagtgagggccctattactctcctgttcttttggcatgatcttgttttactttgatagtatctgcaatagactatatttttatgttccccaaaattcatatattgaaacctcatccccagcgtgatgatatttgaaggtaaggtctttgagtggtaattaggtcatgagggtagaagctaaatgactgggatagtgtgcttgtcaagagatcccagagagatcccttgcctcttccatcatgtgatgagacagagccttgacattgtctataaaccgggaagatagacttcagcaggcaccgaatctgccaatgccttaatctgggaccccctagtctccagaactgtgagaaatacctttctgtgttttataatccatcagtttatggtattttgttacagaagcctgaatagactaagacagtatctttgcttactggcacctagagatatttcaggctccttgtgaacatttctttcctaagcttacaatcagatgttttgaaagaagattccctttattagaacttatttagaaattataatcttagaaataggactgtgtattgataccatttgcccactgcttctagcattttttaatgaatagggcaaggaaacaatgtttccataaagagggaaaatcattattttacagtgatattttctgattcaaatttaagagattttacttaaaatatttgattttatagttaaatataatttacattagattctaacaacttttacaaaattactaattttcattattttacaaaaaagttattaataaaagactgctgaataaaggttttttttcttgttctttttgtccatagaatatatctcattgaaaatgcatagggaaaatactggtgttagttggaataattattttctctatgtgtttatgccatgatcttaacatatagttacaaatttatttgttttattatttttatttacttttgggggattttaacttttttttgtttccttgattattaaaaacaattacatgagtgtaacacaaaaagtatattacaaagtatgtcagataatttttgccttcatcctaatttcctctacctttcttctatagatagaaagtagttaatcctttctatttgttttgctttattcttccaggattttcttttttttttttttttttaaacaatgaagcaattatatctatatctatctgttatctatctatctatctatctatctatctatctatctatctatcatctatcatcatctatctctaactgtaatctgtattcctctcctttctttacaaaaggtaggtcatgtacattgttctgtacattgctctttttacattttacagctgcatagtcttctatcatgtgaatgctccagttatttaacatttggtttatttcttatcctttgctatttaaaaacatcagaaagaataacatacatagctttgcaagtgtattttcaggacagattcctaaaagtgaggttgatgtgcaaaagggtaaatgcatatttactttcactgggtatcttagttcagttgggctgctataacaaaatactgttgactgggcagcttatacacaactgatatttattttttgtagttctgaaggctgagaagtccaagatcaaggtgtcaccagatttggtatctggtgagggcctgcttcctggttgatagatggtgtcttccttccatctcctcacatggtagaaggagcaagtaatctctctggcatctctttctatgaaggtattaatcccattcaggaggtctatccccatgacctaatcacctcccaaaggccccacctctgaatagcatcaactgaggagttagtatttcaacataaaaatcttgtaggacacattggtatgtggtatgtcttcagaacataccactaaatatcactaaattctattcaaaggagccataacagttgcatttcctccaacagtgtatgacagtacctgtcttccctcagtcttgctaacagagtatgttgacaaacatttggaattttgcctatctgataagttaaaaattatattacagtatagttttgatgttttacttcacgtatgagtgcagttgaatgtctttcaaatgttgcagcttttgtatttcttcatcttcaaatgtctattcatatatagtatctatatttctgttagattttctcttttttgaaataagtttattgagttataatatatttacagtaagcttcatcctttatagatgtatactttcataaattttcacaaatgtgtatggtcatgcattatcatctaactaccaccacaatgaatatattgaatctgaaaaggatttgtttctctttgttttgaagattgtcaaaatttttaatatattgatattacccctgatatggtttggctctgcgtccctgtgcaaatctcatgttgaatttgaatccctagtgttggggtagggacctagtgagaggtaattggatcatgggggtggattacatccttgctgttctcataatagtgagtgagttcttatgagatctggttgtttgaaagtgtgtagcacttccccctttcttcctcctgctccagccatgtagtgtagtgcatgctagtttcccgtttgccttctgccatgattgtaagtatcctgaggcctcctcagctgtgcttcctttacagcctgcagaaccataagtcaattaacattttttcttcataaattacccagtttcaggtagtcctttacagcattgtgagaatggactaatagaaccttttgaaataaaggttgcaaatattttttctttcttttttttttgtcttttttttgagacgaaatctcactctatgacccaggctagagtgcagtggtgcgatctcactgcaacctccgcctcctggatttaagcaattcttctgcctcagcctcccaagtagctgggaccacaggcatgcgccaccatgcccagctaattttttgtattttattagtagagatggtgtttcactgtgttagccaggatggtctcgatctcttgacctcatgatacacctgcctcggcctcccaaagtgctgggattgcaaatattttttcatagttaataatttttttcagtctttgctcgtattatattttaccatacaaaagtttttaaaatgatattttattgagtgtgctagtcttcccttttatttcttctagatttaaagctttccttgtttgtaaaggaaacctatattttctcacagaactcataaagttttattttttaatatttaaatctctaatccatttgtattttatacagtacctagtataaattatagattagattagattttctcacgaagttttatgcaattgtctggagatcattttttaaagtttacttttctcactatttttatttgtcacctttattacatattaaatttctatatgtacttggatctatttttattttgtctattgtgttccattcacctacttgcctattcaaaggctatttaacttttaattataaataatttatcataaatgtttaatgtcatcttacctgaaaagcaaggccttcctcttgctctctttctcatcattgtgtgatgttgagagaatataaaaacataaacaataatttaaattgtattcagtattttattttgaatcatgaatagtgtaaaattaaaatgtttgtgacacaaagataatctttttctttcttaggttctattcatacaataaattatattgctatatttgttaataacgagccttttcagaaatgagccccagaatgcatttttaatagtatattacattctgtttgctgagattttatttgactttttattatcactcttaaggtttttatattaatctatgctatcttcataaagatttattatgttttactctttgcctatacaacagacaaatttaagtagtattaggactatctgattttgaagcttcttagaattgtctacaaaaagctatctaagtctggtggtttggtttctccttggaaactcttcacaaatttctttacttctattaaaatggttatatagtcagctctctgtatctgcagtttccatatgtgcatactcaaccaactgtggagaaaagagattcaggaaaaaacataaaaaagatggagtactatgcagccttaaaaaagaataaaatcatgtcctttgcagtaacacagatggagctcgaggccattatcctaagtgagctaacacaagaatagaaaagcaaatactacatattctcatttataagtgggagctaaagactgaagacacatgaacataaagatgggacaaaagacactagggaccactacatgagggaaggagtgatgggggcatggtgtgaacaaccacctgtgggtaggatacttactgcctggatgacagatggttgggccctcaagcctccacatcacacaatttacacatgtaacaaacctacatgtgtaccttttaatgtataataaaatttgaaattataaaaaaatttaaaaaataaaatcgaaaaatacaaataataaatatgatgtaacaacaatgtatatagcacttacattgattaggtattataagtaatctagagataatataaagcatataggagggcctgggaggcagagcaagatggtagaatagaaaactccattgagaaaactccacgcaaggaaaccaatttaacaactagctacacagaaaaaacaccttcataagaaccaaaaatcagatgagcactcatagtacctagttttaattttgtatcactgaaagcagcgttgaagagatagtagtagaaaaaaaacagataagatagaataagcagagacagaaaaaataacagtcctgaatgactggtgccacccctcccccacacccctgcagcagcagcttagcacagagagcctctctgggcactggggaagggagattgtgaggcaattatgaggcattaaactcaatgctgttctgttagagaagaaaggaaaaccagaccaaactaagctgacactcacacatggagggtacatttaaaccagccctagccagaggagatatcgtcagtcccagtggtctgaacttgagttcccacaaacatggctactgagggctacagtgctctgtgtttctaaataaacttgaaaagcagactaggccatgaagagtgtaatgcttaggagagtcttagtgctaaactgggcccagagacagtagactgtgggggagcacacaactactgagacaccagctgggcagccaagtgagtactggcatcaccgttcccctaaccccaggttgcacagtttgtggttccataagagatgccttccttgtccttgaggagaggaaagggaagagttggggggactttatcttgcaacttggacaccagctcagccacagcagaatagggcaccagtcagagtcatgagtccaccatcctagaccccagctccctgacaacatttctagacacatcctgggccagaagggaaactactgccttgaaggaaattacccagtcttggcgacatgcatcatcaccagctaactgaagagctctcgagcttgaataacaagcaatgatatccaggtgctatgttgaaggccttgggtgagtctctgagacttgctggcttctggtaccagcatgaccacaagaggttagagcaccaagcgggattttggggtcactgatttccagaacttgactcttggttggcatttctggacctgccctgggcaagaggggagcccactaccctgaaaaatgagtcttaggcccaagaagcatccaccacaagttgacttaggagagccttcggccttaaaggaacctctgtggtcgtctggcagtattcctcataaccgagggtggcagcagctacagagtgaggctcctctgcctgtggaaaggggagggaagagtaggaaggactgcatcttgtggtttgagtgccatgtcagctgcaatacaatagaataccaggtagacttctaaggtttttgactatagtccttgactcctgacggtaactgtggaccccccagggacctggggaactgcattgccctgaagggaaggacacaggcctggctggttttgccattgcctgatcatagagccctgggtcttgagggaacataggcagtagtccttattttttatgttttgttatttatttattattttttgaaacagagtcttgctctgccacccaggctgaaatgtagtggcatgaccacagctctttgtagtcctgacctcccaggctaaatgaaccctcccaccttaaccctcctagtagctaggactgcaggcataagccaccatgcccagataattttttaattggccacattgcccaggctgctcttaaactcctcacctcagcaatcctcctgcctcagtcaccaaaagtggtgggattaacaaacatgagccaccatccctggccattttgtgattttcaatagtatttttccttcacctaagtagcttaacaggaggtggttttactttctaggtagaggggactgttttggtttttgattttgtcattaatttataactttgttgtattgtgatgaagattactacttctattaattatctttttgaaatttagtgattttctgagatctaatatacggtaaatttttagaaagaatgtgtgttttctatttctggaattcagagtttaacatatatccattcatgtagaattatcttgctgattaagtttttaggttttgtttatactcattattgttttgttctcttcatttgtcttggacaggaaggtgtgttaaagccttcattattagtggtttctgtctgttttcttcttgcctcccttgtagttctgccttataaaagttttaactttacatttgctttataaatgttaacaacttttgttgtcattgtaaattatagcttttggtattaaagttaccatcatttaatgatttttggcctgaattgtacctgatatgaagatgataatacctgatttttatttgtattttcctggaatgtgtatatgtttaccaaacttcccttattttttaatcttgctgaattatcttgttttagatttatctctcacatgtagcatagagttgggttttgctttatttaacaatttaaaaagttttcttttttaatagatgatgttaaactgtttacatttatggatataagcaatatgtttaaattagattccattatattatgatatactactatatacatgtgtattttttcaccaataggtcttttcatttgctttctctctattatttttagcatttttttgttatttagtaagttttagtttttgttgtattttatcttcagtctcttcatttattagatacggtctattaaaattccttaccatgaaaaatgatgatgttagtttgtaacc[450 bp omitted]gggcttcatctataaccaacatcaccatagtttagcaatgaatatttttgttagtattaatcagcagcaattactactgccatgacttttccttctgagagatagagaggaagaagctcaaatcctatctgaaaatcactttagaaaagtgttggatatggagaagaatgttctaggcagaggaatcaccatatacaaagacaaagaggtgaggccaagtataatataataggaaaataaagtatacttagtttgcaaggtgtgtttaggaacagtgagagatgaatttgaaaaggtaggcaagagtcttttataattttataggcttaagattttgttctaaaattaataggagccactgacggattttaaacataggagcgttggtcatcacaacatattttttggaagaatcactttgtcagaagacagacttgacaggactgaatgactgacaggactgaatgactgataaaatgtggaggtgagggagaagagaagtccaggatcttttcccactggtacgaatggttggatagatggtgcccttcctaaaattaggaatgcgggaaaagtagaaagcctgattagaaaaatatcttggcttggctttgtacatactgaggttgaggtgattatggagcacacagggtgaaaatgtataatcaatagctgtcattatgtgtaaaaattcaggaggaagattggaggcagaaataaagatttggtctttttgtcatcaaaaatcttttcattggaaaattcctataccaatgttagttattgttgtcatcaccacagcagttgttattttgaagacaaacattacattgtagagttattcttccttatatttaatttgaaaatatttactttctaaaatgcataagcttggggtagaatgataattttcaggctctgtgaagcttcatgtatgagcaaagaaggaaatgctgtcaaaagggaaagaaatatttttcctaatccaaaatgacttcatttccagcagttccagagaattttattttaactttcattcacaaatgctttaacaaggttaaactgaagcaatgaagacagctttattaattcgaatctttcaatactgtcacgctttctttgctaggaagtcaggagcttatgttttaaaaaattcattaaaatgccagtgtgcatcagtcagagaaatcattttaaaaacattttaatcttaaatgtagggtgaaaaaaaccttcacactcatttatttttgtgccaagaaataaaagctcaattgagcaatgggatgagttagagtctggattgtacagagtggctgaagaactactcactgattcaattcaatgcatagtttttcatcaccactcaaaattgcagagccaagcctaagttaaaaaaatacataagagaaaagcagcctttgctgattgtttgccaatttgtcctttacaggataaaggcatattaaaaacacaatttttacaagatttttaacaggtctgaaattctcattcttatttagcctaaggcgataattcttacattttttttggtgtgtgtcttagagcattttgagagcctgatgacagaagtggattctcttctgagaaaaatgctcatatttacaatatttttcacactattttggggcattcttgacataccattttccctgaagtccagagatttcagataataaactgctggttgagatatttaatcctctgagatagtcatttgaaggacaattcaacttttaatcttgagcttgagccttgacattaacacaaaactgtattacacctttgtttgaaagagatctgaatctcaagggatggtatgagctatacattagcttttctactggaatatatccactctttatatgtacttacttggcctagtcactcagaaaaaggaaacaatatttttattacaaatttgtttgaaaaaacctaattaatgaaataaaatcagactgtctaggaagttggacattggaactagaatgatgtttaagaaacatggtcaacccctacctctcactacagacaaaactaattcaagatggattaaagatttaaaggtagggcctcaaactataaaaattctagaagaaaacctaggaaatacttttctgggcattagcctaggcaaagaatttatgactaagtcctcaaaaggaaacacaacagaaacaaaaattgacaattaaaacctaattaaactaatgagcttctgtacaaaaaatgaaactattcacagagtaaacagacaacctacagatttggagaaaatatctgcaatctgtgcatctgacaagggactattatccaaaatctataaggaacttagaaaatcaacaagaaaaaaacaagcaaccccattaagaagtaggcaaagaacatgaacaaatgcttctcaaaagacacacaagctaccagtaaacatgaaaaaatgctcattgtcactaatcatcagagaaatggaaaatcaaaaccacaatgagataccacctcacacgcatcataatggctattattaaataaagtaaaaaagtaacagatattggcaaggttgcaagtaaatgagaatgcttacacacactcttggtgagaatgtaaattagttcagccactgtggaaagcagtttggagatttcttcaagaactaaaaatagaactaccatttgactcagcaatcccattactggttatatacccaaaggaaaataaatcactgtatcaaaagacacttgctctctcatctttattatagcactttcacagtagcaaaggcagggaatcaacctaggtacccatcaacagtgaactggataaagaatatgtggtacatagacactatggaattgatatagccataaaataacaaaattatgtcttttgctgcaacatggatgcagctggaggccataatcctaagtgatttaatgcagagacagaaaaccaaatatcacttgttctcacttataagtaggactaaacattgggtacatggacataaagttgggaacagtagacactaggaacttcagaaggggaaagtggggtggggaaagtgttgaaaaactatctactgagtattatgttcaccatttgggtaacaggttcaattaaagcccaaacttcagcattacacaatttacccatgtaacaaacctgcacatgtccctcctgaatttaaaaatttaaaaatttaaaaaaaatttaaaagaagcataaggccatggaatatatttaaatcaccattatccagagagtccttctagctcttggatggatggatgatcaacatcttaaccctatacctgaagagcaacaggtgggaagggttagggaaggaagcactgtgtttggtctctgacatatattttctgtttctaaatgcatgctgtattagttcgttttcacactgttataaagaaatacccaagactgagtaattcataaagaaaaaaggtgtaattgactcacagatctgcatggctggggagcccactggaaacttacaatcatggcagaaggggaagcaggcacgagagagagcacgtgaaaagtccaagaaaaactgtcatttataaaaccatcagatcttgagaggactccctaactatcatgaataagcatgggggaaactgtctccatgatccagtcacctcctaccaggcctctccctcaacacctggggattaccactcaagttgacatttgggtaagggcacaaagctaaccatatcacatgtccttaatttgtcccttaatttggaaatttagtttccactttttgcctcaaaatagactttttttttattatccagacatttaattattgatttgatttttacaatttaacacatttgtttttttcatcagacatagcaccacctgaggttggttcagcagaattgagagtgagtacatctctaaaataagttctgtgtctaaaaactattttaaaataaatatatgtgttcttaaaaggaaatacgcagagtggctgccagtttacctcctcatatttgtataacgttttaattcatgaaaggttttcatattaatgacctgcagtttgaataaaaggcaaacattgctatgccaaactcacaggtgaggaaactgaggctaaaagaattgcaacatactgttgataaatgacagagctgagaatccacctcaggtctcccaatctttatgtgatgcataagtttccaaatgtatttcaaaagtccattttattcctttatacttatgtaggtaaattgaataattacttgaagcatacaactatttaacaacaatatatatcatcatgatttaatattgccaaaggtctgttcctggccttatttcagtcctactacctatctctgctatggattctaaaccaggattagtctgaattatgcctgagaaccagtttgctctcatgagaaaagtagttgttttatttttttaaataaagttcatataaattagtgcttctgtttgatgtcacttttcagaacaattcatgtatgaaaggtcatttcacattagccttgcaaaagaattacctaattttccatatactagttgcataaagggttatagttataataaaaacccattgccaggaatgccacagcgaatgtctctactttgcacatgatgtcatttctatgttcctagtgcctagcagagagcatggcactgaaatgttggtttaattgaattatttcacaatgtcacaacataggccttgtggaagcagagtttgaataaagaaacaatttcctaaagtttcaaaactttacagaacgcttaaccttcataaaggagaaaagtcctaaactggaagagttttaaaactataaaactcgaaaacatacttaattctaatatcacacataaaacacgattaggaaatagtgaaggaaagctcaccaaacacttaaatctgctacacattcaactggatttctcattgaatatgaaaactgaagtttctcttttctcattttttacatctttgcttctaaatgctgactgattacttttagatgaaatatattttcattgctatatgttaaaacacacacatgcacacgagcgcgcgcacacacacacacacacacacacacaccccgcaatgctgacagcagaaaattcatgcttccatggttttaacagctcaaccagcaccttcctttcaattttatgtaggatagtgctgcacccttcttctatatcattaagcactaattgcccaattacagagctttgggacactgctaaaattgtgcctgaagcttttaagcaaattcagctttaaagcaaatgatcccagtagtcaaaattatttactaaacacagcacagtttcttctagatagattatttaaggcctattacgcttgctagatccttatagtacaaaatacttgggtatttagtgagactgttccctcttttcataaagcttttttatattcagcaccaaaatgtaaaaggagtattatgtatttgggtagagaggactcacgcaaatattcttaacctgaaaaacagttttctttttcttaggctgttttgaagaagggataaagagttgttctgcatcagagcattatttgtaaatatagagttaaaaggtttatttaaaaaaaactctctttttgttcaaatatatatagccatgtaaactataagggatttgaatgtgttctaactgattccattatttgggcatacccctttttaaatttctgttcgggatattttgtcaatcctttgcattactgacaacaaataataaccattgtggactgtgttaggcattttctccattttctcacatagttctcattagtcttctcgacagctctcagctattcccaacttcattttacagaagaggaaattgaggcttttggtgggtaaataacccacctaggatcacattgctgataagtggcaggagaatattaagtataacttaaaaaactgaaaaccatggtacaaattataatatttccagaagatagaaaccaaaaaataaagcaccaaatactaaaacacagatcttaacaatacactgaaaaaaactgaatataatatattttaaaatttggaacatgtttttaataaaatacttttttaaagcccataatgaattcttttaaaagttagtctctaatttatccttcataataatctgggttttcagatatcaggtctgcttaaggtggggtccatcttcaccatttggaactatatccatctaacacttgaaaagtgagccatccttcactgtatataattcatacatttcaccactctctgtctttatagttaatgaagattgtggttgtctttattgtattgataacttataacggtatttacatcaaaccaagttgacctctatgttaggtcattctcatacggctgtgaagaaatttataagaaaagaggtttttaattgactcatggttctgcaggctgtacaggaagcatagcagcatctgttctggggaggtctcaggagtcttccaattatggtggacggtaaaaggggagcagagcacataacatggcagaagcaggagcaagagagggagaaagtggagatgggaggtgctacacactgttaaatgaccagaccttgtgagaactcagtatcacaaagacagcacccagccaagaaggattcgccaccattattcaaatgccttccacccggccccacctccagcactgggggttacaatacaacatgagatgtggaagcaggggcataatatccaaactatattaatctataatgtccttttatgccttcctctgatcttttagaacctgtagccaaactgtacttataattatgcagttcaaatgcaacatagaaatactattgacttttatcattaacagtttttcctttggggaaatttttttaaagcctataattttttttttttgtagtttagagaaaatccaaaaggaggtgtttactcagaagaatcagccaaccaatcgaagaaacaacaaaacagattcttagaaagaaaacaaaacaaacaacaacaacaaaaaacttacttcagtgtagtttcagacttgccttacacagagtaggcaaacaaaatatttgttaaactgaattatatgggctatttcttgtgtcaagaacatttctttgcagtaatctttgacatttttgcaagttgaactctctggaaaacagactcagatagcaagcaaagtacaggagatttactaggatgtctcctagggctgggcagagggagaagctggttggcaacgcagtgtcacccagagttttagccaacaacatgaggggctctgaggctgagttggcccttccggtttgtgtcctgttatgatgagaggcctcaggtctttgtaatctgtcattgattagtcactgaatattggctgctaccttccctccctgggaaggtggcctgaccatggacaaggcaactttctccagctcatggcaaattctgatagggctgaccacagagatagcactacttccagcagctggtggaataagtcttggtatcctgacgtgggatctgagagaagtagcactgtattcatattcactacaaacactgtggccggtgagtgaaatgaaacaaaaataacaaggaatattttcactgtgctgttccattccaacactccatctttcaaactcgaattctgttaaatgacagacatttgtgtgtgtgtgtgtgtgtgtgtgtgtgtgtgtttctttcattactctcaactcacagttaggcttgtgagatctgacttggctcattattgtgacaatttcctattcattatctcacatagcagggagcctctttggaccatcaagcttataaatttacaattgcacattaatccgtggaatataattgctggttgctgcctctaggcttggggcacactgtagatgccaggatatacacaattacccccaaggtttgcttaggagcctttgcccatccaacaagaaaatgagcattgcaataattgagaaaatgagcaccttgggtctttctcttgctggcaatggttagaaactcttatcattgaattgccctgctttgtttcttgttttctctcataaatattgctaggaaataagctatttggtacacaaagagttttagcttgtttgggttgaggaaggtaaactacaagatgaagaagtgttaagtcctaatgccttacagactcagcactcagacttttttatgaaagttttttcactagatggaccagggaggtggagaggggcaaaattttacctgggagttgtggaaatcacataaaagtgtatacataattttggatacatatacattcgtacatttttctttcttttcttttctttttccagagggaattgtccatagctatcattagatgctcaaagtgatctatgaccacaaaagtttaggaattattatattaaaacaaaaaagactcatttattttctgattttaagctatcatctttctatgcctaaacatgtatttggacaccccacaagcaccttattccactttaaatgactaattcatcacaagtgaactctatcactattttctctatttctgtaagtcatatcacattcatttaaattgttcagttcagaaatggaagcattagtcccttctcgtcttctttgttttccacatctgagatccatgtgatgacatggctgaaagacaaagtatcttccattttataaatcttacttaccttggtggtctttgggtatatcactgctcagaatgttttatgaagccccattcaatgataaaatggtttttggacatgataattataaaggaagagtagtagaaaatgtttctttataaaggtacctaatcctgggaagtccaaggatagaaggaaagagccagtgagacctggtttatgagacaatgcttagatagcttttttttttttttggtgaatggattagatggcctttcacagaccagtctaaattttgctgtgttagctgtagcatggtgattatgaaggggaaggtatatgtgttggaatcaaccacaggtaggctgggtttgggaggccaataatctttgaagtgattatgtgaactctgctcagtagcaatgctttatatttagtcggacaaaagggcccattcaaattcacaagttttggaaaacacaaatgccaggtgagcaaagaaaagaacatgaaagcacaggttcttgttcctaggaaagttaggtagaatttcccagtgtcttatgaaatttgctacatattcctgagcaggaaattgttctgctaagtcctctttttctgtttcccatatatccttgcaatagatttatccttataggcaatttgtgtatctcttctttagaactcacaagagtctggcctgctggactagtaaaacttctctagctaaaagggaatatttccctgccagtgatctcataggtgtttactgatgcctgaaattccagcaacaatatacaaagccttttattcaacaaggaaagatgcagaatagggaaggaaaagaaggaagtcaactaatgtttgctgtgcatctatcatggctctggcactatgctaagccccatattcagatgacttatttgtgcacttgattctactttccaaggtagttatacttatcccagaagaaaaaactaatgcccagtgagtttacgcaacttgcccaaagtcagtcacttttttccttaggggattttgttatcactgtgacagcggcactgtgacccaggatgattcacttaaatgtttggtacttagggaagccctttacctctatccttttgtttagatttggaccaggagggaagagagtaaaactagctatgaaggagaaagaaagtttgatgtaggacttgttatttaataatttctttagctccaagtcaactctcttatgctccattgtttgatactgctgtggggccctgcaaactatattttctagcctcctttgtctaggtggttttttttaatagaaccagccaatagggggtaccgtagagagacaggaaagtgggtgcaagggaggaggcactttatctttttgcctgttcctacactgtgggaccagaaacagtgtcagccctagcagcagttgttggctgcaacatctgaggatttccaatactttaagaaccagtgtcttcatattccctcataggaatcacctgcagggaatggtgtgctccctcctcagaagcctgcaaaccaactccatggggctcccggtccaagctcctaagttgttgtagccccacttcttccctttcttctagccttagagtggcagcagcttcctccctgggctacctcagtgttcccttttttgttctttcagttgtacaatgccctttgcaccgaattccttgtatgaaaacctctgtttttgaaatgttatgatggtttttgttttcctgaccagaaattgatggtgtgtgtttgtatggctaacatggagagtagatagacaattgggagtaccaaaggcttgagaaaaataaaagtctttaatttggcccagcaaactgctagctgcatcaatggattgttagaagaggagttgtcttgaccgagaggcctttggaagaaaatgtctgaatttcatgtcatccacagtaagagcgtttcttaatgcatgaaggcatgagatctagaaagaggctctgaatattatgtctctttaaagtaaatgcaaaaagtcacacacagtgtcttagtccatttatgcaggtatgtcaaaataccttagactgggtaatttataaagcagagaaagttattttttcccagttctggagcctgggaagtccaagatcaagccaccagcatcatgtctggtgagggctgctctctgcttctaggatggcaccttgatgctgcatcctctggagcgggagaacactgtatcatcacatggcagaagggatggaaaggcaaaaaggggtgaatttcctccatcaagcccttttataaggctacctaatctcattcatgaaggcgtagccctcatgactcaatcacccctaaaggtcacaccttttaataatgttgcattggaaattaagtttcaacatgaattttaaaggagtcaaaaacatttaaatcatggcacacaggaaccagatttccatattatagcatatttttactatctcaggtggtaaaagagaattacttgcaatttaatccctttcactagagacacaagagcaatcttcccttatgtgtccaatgtctttttcaccttcctagagtttgggatgagatggtgtgcaagatttgatcttccccccaccacagattgcctgtgtttcctttctactcaaatgtcagtgaatgctttcaactgttttctaagggaacaaattacctatttatcgaaatgagttaactgtagcttgctgacaaacagtattccattttcaggagcagctgtcagatttaaaacattaaaatcccatcaaaaacatttcaggaaatacagccaaaaccttacaaatgactttctaaaatctgttctgctctgatgtattcaagataattaattggcatagtacttttcatgttctgagtatgttttttttaagttgataaatgtgtttcaggtgttctcatagatatattaccttaaatttaacaaatggacaccacatgcagtgataaaaataaaaatgaccatgatacaatggagacctacaatatgtccaaaaatgatgaaacctttttccatgctggcacaggggaaagcacaattacttgtacctctcctgtgtttaacattttccttcaccctggtctcccatagagctcttcggcagttcactagatggaatggccgaaagtcccatgtggtagagtcaaaaggcccctacgtcctaaacaatttgaaatagtgaacgtctagaattccaactaaatctcagttttctgaaatgtacttaatataatattgtcccacagttgctcgacaaaaacaagattttcaaagccaaacaaattgggacagttaggcatactatcactatttcctggaggtttagcttgtaaaacacaagttaaaggctctgagaactcctgcagtaaagaaactggtttaaatttgtggaagtagtaacttccacatttatatgatcatagagcctctcatcttttacattttgtatgatcaacaccccaaactaatagttgttggaacacattttttggcaatactgtatatgaataaaaggaagttaggtaaagatatttaaaggtccttcagcaaaagagtaaagcctagagaagatgagattctaataaatatttactttctgaaaaatatatggtattttatattagttagatgtctctgttgaaagtgacagaaaaactgtttcaaagtggtttaaagcaaaaatgttaatttagtgtttcacattgaaaaattcagggtagacttcgcttcagacactgctaaattctaaaataaagaaatgttttacttttagttctaccattattctcagaatcctcgtatagtctctggaaacccatcttatccatatgtggcagcatgacagctgtaaaatcttcagtcatttatattttcaggatctagtgtagtgggaaagagaccctctctttccctccacgctagctggagctagtggtggagacacattcaaattgagtacatttccctggtctatttttatattgtgctaacaggaaaaaatatcgaaaacattttcaaagttacatgtgcttacttgagcatcaggagaaagggataagcttggttgactggattcccatactgcatcccgacaaactggaaagagatcctggttagaagcaatcattgcttttatccagagaaaagcaatctgtttctctggataacccatcaatggagcagtgtgttagttagggttatccagagaaacagatatatatatatatatatatatatatatatatatatatatatatatatatatatatatgtctatatatttatatatatatatgtatgtgtatatatatatatatatatatatatatatatatatatgaaggtatattatgggaattggcccacatgatgatgaaggctgcgaaatcctttaatatgccatctgccaggtggagaaccaggaaagcctgtggagtaattcagtgtgagcccaaaattccaagaacaaggcactcctttatcagacagctggagaagatagatgtcccaactcaaggagaaaaaaatttgctgttccttcacctttttgttctctctggatccccagtggactggataatgctcacccacgttggagagaggaccttcttcactcagtctattgattcaaatgctaatctcttttagaaatacacctggaaataacgttttaccagttgtctgggcatccctttaacccattcaaattgacagataaaattaagtatcacaagtggaaaggaaagcagaagctcttagaaaaaaaattgtattgaccatcaaatgccgtaatatggccttagtaatttgcattagcaggagcccccagagccacagaaagaagaggatgaagatagagaaggaagaagggaagcccatggttgaccctcacagaatctccttcctttggcttctatgatttctcctctttccagcgtctatttcctcacaattctccatcacttgtagggttattccagttcttcaccttgccagtcttgctttcccttccaaaactccaagaatatctatctgtccttgcaaatgattacatagcccctgacttgtggcttgggtttggagtctccttatttccggtgtatggtgagaaatggaatgtaaattattgtttattgtaaatagaaaagatattttcctggcaatgcaacatagcagtctgagaaatttcccttctccccacctgtgtgaatactttatatgtattgaagttcaatctgtgtctatgtgtgtgtatatcttgataattttatgtgttgtttcccaaagtacctcatagattggctcctctcatcctagcctcctctctcaccactcccttacttacactttttgcttcatcagtgcaagcctcctgtatttccacatgcattctcttactatgtaccactgtctttggttgaggtttcctcaatacagcctgtgccagtaatttattgagggagtgctcttaggagaaacctggagaggattgagggaagcaggatagaacagagaaagacatcaggcaaacatgtgggttcaactgaccctgtggggagctctggaacatgaagaataccacaaagtttttctgtcttaaggtaattggactagccttttatttctccatatcattcagtcattggttgaggattatttttgaaaagggcataccctgccattcctagatgagccacctctcatgagctgagaatgagtctcaggagcagagtgcagctctgaactgttaagaaccaatactgagagcgactggaagatctattaacaactttcctaagtgcttaattacagcattcactccctgaaaattcatcagcccttcctcatgctttattgcttaaaaattgacctatactgtgcttttcaaactttagtgtgcatcagaattgccttgagcattcgttaaaactcagattgcttactcttgccctcagagcttctgattcagtagctcttagactgggcctagtaatttatacttctttctttcttttggtgtaatttttatttctcaaaatttttcatttttaaacgttattttaaaacacgtttgtaggtacattgtaggtgtgtatatttatgggatacataaaatgttttgatacaggcatggcaacatgaaataatcacatactgaagaatgggatatccatcccctcaagcatttattttttgagttacaaacaatgcaattatactccaagttattttaaaatatacagttaagttattatagattatagccaccctattgtgttatcaaacaggctgtcttattcattatttccacttttgttgtaccaattaactatctccatctcctaccccatccccattacctttccagcctctagtaactatccttctatgctctatgtccatgagttcaattgctttgatttttggatcccacaataagtgagaacatgcaatgtttgtctttctgtgcttggcttattttacttaacataattatcttcagttccttcaatgttgttgcagatgactggatctcattcttttttcgtggctaaatagggctccattgtgcatatgtaccacgtttgcttcatgcattcatctgttgatggactcttaggttgcttccaaatctcagttatttttacagtgccacaacaaacataggagtgcagatatctctttgatataatgatttcctttcttttgggtgtataccccatagtgggattcctggatcatatggtagctcagtttttagttttttggggcaacttccaaacagtttcccagcatggttgaactaatttacattcccaccatcagtgtacaagggtttccttttgtccacatcctcaccaacatttgttactgcctgtcttttggatatgaaccattttaactggggtgagatatctcattgtagttttgatttgcatttctctgatgatcaatgatattgagcactttttcatatatctcattgccatttgtacgtcttcttttgagaaatatctattcaaatctttgctcgttccttaatcagagtcttagatttttttcctatatagttgttttagatctttatatattctggttattaatcccttgtcagagaggtagtctgcaaatatttttttcccattctgtgggttgtctcttcattttcttgattgtattctttgctatgcggaagctttttaacttgatgtgatcccatttgtccatgtgtgttctggttgcttgagcatgtggggtattgctgaagaaatctgccgagaccagtgtcctgaagattttcctcaatgttttcttgtattactttcatagtttaatgtcttagatttaagtctttaatccattttcatttgatttttgtatatggtaaaagataggggccttgttttattcttttgcatatggatatccagtttcccagtaccatatattgaagagattgtcttttccccagtgtaagttattggcacctttcttgaaaatgagttaactgtaggtgtgtgaatttatttctgtgttctttattttgctccattggtatatatgtctgtttttatgccggtactatgctgttttagttactatatttctgtagtatgatttgaagttaggtagtgtgattcctccagttttgttctttttgctcatgacagcatggctattctgcgtcttttgtggctccatataaattttaggatttttttttctatttctatgaagaatgtctggtattttgataggaattgcatggaatctatatgttgctttgggtagtatggacatttttaacaatattgattcttccaatccatgaacatgcaatatttttccatttttggtgtcctcttcaatttgtttaatcagtgttttgtagtttttattatatatatctttcactactaattaattacttacttacttaattaattaattactaattaattactaggtatttaattttatgtgtggctattgtaaatgggattactttttaattctttttttcagattgttcactgttgacatatagaaatgctactaatttttgtgtgttaattttataccctgcaactttactgtatttgtttctcagttctaatagttttcttgtggagtctttagattgttccaagtatgagatcatatcagccgacaagaataatttgactttttcctttccaatttggatcccctttatatctttcttttgtctgattgttcttgttgggacttccagtgctatgttgaataacggtattaaaagtggacatccttgttgtgttccagattttagaggaaaggcttttatattttccccattcagtatgatactagctgtgggtctgtcatatatggcttttattaagttgaggtatgtttcttctatccccagttttttgaggatttttatcatgaagaaatgttgaatttcatcaaattttagttatctatcaattgaaatgatcgtataattatattcttcattctgttggtgtgatgtatcatgttgattgatttgcatttgttgaaccgtccttggatcccagggataaatcccacttggccataataaatgacctttgtaatgcattgttaaattttgtttgccaggattttgttgagaacttttgcatcaatattcattagaaacattggcctgtattttttttaatgtgtctttgtctggttttggtttcagagtaatactggcctcgtagattgagtttggaagtactccttccttctctatttttcagaatcgttcaagtaggattggtatcatctttaaatgtttggtagaattcagcagtgaagccttcaggtcctgggattttctttactagaagacttttcctgatgtcttcaatcttgttacttgctattggtctattcagattttggatttcttcctggttcattcttggtaggttgtttacatctaagaatttgtccatttcttctaaattttccaatttattggcatgtatttgttcatattagccactaatgaacctttgagtttctgcaatataagttgtaatgtctcctttttcatctctgatttaatttatttgaatcttctctgtttttttcttagtctggctaagggttggtcaattttgcttaagtttttaaaaaacaacttgtttcatttcattgatctttcatattgttttcttcatttcaaatttatttgctcttgcttttctagttctctacaatgtgttgtcagatcatttaaagtttttcctctttttcttgatgtaggcacttatagctataaagttccctcttggtactacttttgctgtatcccatcggttttgatatgttgtgtttccattattatttgtttcaataaattttgtaattgccttcctaatttctttattgacccactggttgttcaggagcatattgtttaatttccatctatttgtatagtttccaaaattcctcttgttattaatttctagttttattccattgcggtcagagaagatgcttgatattatttaaattttttgaatgttttaaggcttgttttgttacctaacatatggtctgtccttgagaatgatccatgtgctgaggaaaaagatgtgtattatggctgggcgtggtggctcactcctgtaatcccagcactttgggaggccgaggcgggcagatcacaaagtcaggagatcgagatcatacgggctaacacggcaaaaccccgactccactaaaaatacaaaaaattagctggacgtggtggtgggcgcctgtagtcccagctactcaggaggcggaggcaggagaatggcgtgaatccgggaggcggagcttgcagtgagacgagatcgcgccactgcactccagcctgggcgacagagtgagactcagtctcaaaaaaaaaaaaaaaaaaaaaaaaagatgtgtgttctgcagctattggatgaagtgttctgtaaatatctattagattcatttggtctacagtgcagattaagtgtgatgtttgttgattttctgtctggaagatctctccaatattgaaaatgagatgttgatgtctccagctattattgtattgaggcctatttctctcattagctctaatagtattgggtttatataactgaatgttccagtattgggtgcatttatatttaaagttgttacattctcttgctgaattgacccctttatcattatatagtgaccttctttgcctcttcttacagtttttgtcttgaaatcaattttgtgtgatgtgagtatagcaattcctacacttttttatgtttccattggcatggattatctttttccatctctttattttaagtttatatgtgtctttataggtgaagtgtgttacttgtaggcaaaagaacaatgggtcttgttttttcattcattctatcagtctatgtctttttattggacagttcagtccattaaatttattgttattattgataagtaggacttactcttgccattttgttactcattttctggttattttgtggtcttctcttcctttttttctttcctccctgtcttccctttagtgaaagtaattttctctttaaatacaatatagtttattgcttttttgtgtgtctctgttgttttttggtttgaggttactatgaggtttgcaaatactgtcttataattcattttaaactgttaacaacttactatttgtataaacaaacaaacaaaaagaaaactactaaaaccctacaccttaatttcatccttccactttttaatttttcttgtttctatttaaatcttattgtaatatgtcttgaaaagttgtagttattattttttaattggtttattgtttagtctttctacttaggataaaagcagtttacataccacagttacaataataatattctgtgtctttctgtgtacttactattaccagtgggttttgtaccttcaggtaataatttattcctcattaatgtccttttctttctgatttaaatatttcctttaatattttttgtagaatgggtctggtattgatgaattcccctaacttttgtttgggaaagtctttatttctccttcgtgtttgaaaggtattttcactggattctaggttaaaagggttaaaaggcttttttttttttccttcagcactttaaatatgtcatgccactctctcctgccctgtaacattttctctgaaaagtctgctgctagacacattggggctctattttatgctatttgtttcttttctcttgctgcttttaggatcatttctttattcttaacttttgggattttgattattaaataccctgaggtcatcttctttgggttaaatctgcttggagttctatgaccttcttgtacttccatatggatatctttctctagatttgggaagtcccgtatttttattccttcgaataaacgttctactccgattcctttctctacctcctctttaaggtcaataactcttagatttgcccttttgaggctattctttagatcctgtagacttgcttcattgttttttattcctttttcttttgtctcctctggctgtgtatttacaaatagtctgtcttcaagctcactaattctttcttcttcttgatccattttgctattaaaggactctgatgcattcttcagtgtgccaactgcatttttcagctccagaatttcttcttgattcctttaactatttcaatctcttcgttaactttatctgatagaattctgatttttttctctgtgttatcttgaatttctttgagtttcctcaatacagctgtttgaattctccttctgaaaggtcacttatctctgtttctctaggattgatctctggtgccttatttagttcatttggtgaggtcatgttttgctggatggtgttgatgctagtcaatgttcttgggtgtctgggcattgaaaagttaggtacttattgtagtcttcactgtctgagcttatatgtagccatccttcttgggaggctttccagatatttgaaaggacttgggtgttgtgatctaaggctgtatatgctttaggaggcacctcaagcccagtaacactgtagttcttgcagactcacagaggtatcaccttgatggtcttggacaacatccaggagaattctctggattaccaggcagatattcttgttctcttcccttactttcccctaaacgtactgagactctctctctgttttgagacacctggagcagaggtggagtgatacaagcgctcctgtaaccaccaccattatgaatgcagtgggtcagacctgaagccagcacagtactgggtctcacccaaggcctgctgtaaccactccctggctactgcctgtgttcgctcaaggccccagggctctataatcaggcagtggctaagccagccaggcccgtgtccttctttacaggtcagtgagttcccccaggccccgggtgggtactgcagtgtcatctgggagtcagagactagagtcataaaccttagaagtctacctggcattccttttattgcagctgagttggtactcaaactataagatgcagttcttcccactcttcccttgcctttccaaaggcagaaaggcctcacctcgtagccaccaacacccctggccatgtgggataatgatagactaccaccagtgttcccttaatgcccaaggtctcttaagtcagcttgtgttgaaagctgcctggcctagtacttacccttcacggcagtggcttttctctggcccagggcaggtccagaaataccatcaaataatgaagtcctggaattgggtaccctaagagtccacttggtgctctaccccccttgtggccatgttagtacctaaggtgcaagacagagtcccctttacttttccctctggttttctcaagcagaaggaaaggaatttttccctttagccaccacagctggtaatgtgctgagtctcatctgaaaccagtaagtctcagaggctcactaaggccttcgatgtcatacttgggtattgctgcttgttattcaggtcccaagggctctttagttagcaggtgattaatacttccagaactgggtcatttcctttaagacagccagttccctcctggcccaaggtgtgtgtagaaatgttgtctgagagcttgggtctggaacagagaccccatgactctgactagtgtcctatcctgctgtgtctgagctggcatcccagatggaagacaaagttctcccctttgtttcctctcctctcctcaagcagaagaaaggggtctcttttggacccataggctgttcagtctgggaatgggaagggggtgatgccagaactctcttggctgtcccagttggtgtctcagtatgtcacatgtcccctcagttcattgtctctgggcccggttcagccctaggatccacctagaagttgcagtccttatggcctagactgccttttaagtttacttagagacaaaaggctttttgccccttggtggggaggtttgtgggcactcaagtttgggctgctgggattagcaattcccctctggcaagggatggattaaaggcaccatctgtgtgtgggcatctgctaagtttgatttgcttttcctttctgttctaacaggagagaactgagttcagtgcctcacaatttctgagttctccctcttccagtgcccagagatgctctctgaaccatgctgtttctgtctgtggtgggagacagatggcatccacaattcagtactgttttttctgtctcttcagtgcttctttctgagatgtgaagttaaaattaggtactgtgagtgctcacctggtttttggtccttatgaaggtgctctttctgtgtagatagtagttaaatcgatatccttgtttgggggaaccattggtgtagctttctattcttccatcttgttccacctcctagtttagatttctaacaagttcttacatcaggttgatgctgatggtctgaattcacactttttgagactccgtggtgtaatgaatttcacccatccctcatgattcaactgatctatcgtcttcttcagaaaggctttctatccattcatactcccctcgtcctttccttgggtgagtaccttttttatttcacttaataactcatgcacttatcattccacattggagagtctgctccaggtgttaggtgttaggaaggtggtagctagaggtatatgagtatccatcagtagagtgaaaaaaatacatgcttagactcctaaggaaaatctttgaatacatttcccataaaaataaattctgtcctattaccttgtaaatcttgaggacagcaccctgtcttattcatcttagtactcctggctcttagaacttcacctggtgcattgtaggagtcagataaatgtttgttgacttaaacaatatcaaccttattttggattggttttatgggaaagtatgtttaactcacataagttaaatacttacctaagttaaaatatgtttaacttatgggaaaatatgacaacatacaaataaactttgtgggagcataatttattttttagtcgagggttgctttctctagcacactatgtttgtctctaaatgtatgtaggaaggcatttacctgacttttcatacagacacacaaatgagtcatttcaaaaataagcaccatttctggtcccacacttacttaatttatgaacctataatttgcttttggaaaaaccatctcataaaatgatgttgacttgaggtttcagaaaactggcacagagctaggaaaaaaatgtaaacgttgtggcaacacagcaaagaaaaaaatttaagcagcatttgttgttagtagctgttaaatgtaagcattcactgtagcagacagacttcccttagaaaacacaggcaatgacagaggataacaaatagatgttgttgccagtgaaagtatgagtgtttctccagaagaaacatgaaaattgggggaaaaattagcaaaaggccagcttggaagattggttaaggagtatataatgtaatcgctgttcaggtatatattcatcaaagctgttgacatagttctcttattagctaatatttaaaattttgttttaaggaaatggtacatctgtaaagtaccagaggcaagagggtctggagtagttgccattaaacctctttgctaattggacacgctagccactgctacattagtctacaggcttacctgacaggctaaacaaaccgagttaactgaacatctgaaattaatgtgtttactttaaggaacacgaagtctgattcaattagcctccaaagtcatggagcctacagaatttaatgttggaggttttcttttcttttttgttttaatgtgtactccactgtttacagaacccagattaatgaggggatgtattttttttttttgtcttagaggctgaaaacttaaaaaattggatgaaaattatgaagatagtctgacatgatatattaagagctctgaatgatgcctagggatgtagaagaggagaaaaacacttgagtaagtaaacagagtttatgagacttgtttatgccaggaaagcaagatgaatatttctgactaaaagttaattaactattttgcctcagcaagccaatttgtcgtcttaaactttgattcattaactacaagctgagacgattgcttgttccttagtgtacttgtagactgagtttgtgttaaatggtgctgtgagatattggctgttcttcccaattgaaactaaccaaaaaggctattataaagaaagtaagactttttaagtggcagtaagtagatgggtattctttcagagcaaagcctaagaactatatggcttaattgcaaagctaatcagcccttgttaaataaaacaagagtaaatccaggatttttgagtctgcacatttaatgggacatgaaagttgacgatttagcaattctgaagttttaagacttgtgaacttacgagttgttccccttcagggtttttcacttggaggctctaaccctttttttttttttttaatatgttgtgctgagaaaaatgaatctccatttgtcaagatactggctttgtctcttatcattgcatgttttgtgaaagcccatttgttggataaggaacttctttgaactcgtaaatgggcaagtgaaaagcaagaagtttagggaaaaagagtaccaactatactcctagtatatttatctttaagattttaataacagctaaagaagatatgtgaagagtcggaatatatgcttcttttcaaaaagtcacctcatacacaactaaatcaatatcatagggcatatttgtgaaaattcatgtaacttaggtaagttgtgtctgtaaactttgatacaaatggaaaagaggaaacactattcttcacaaggagtgattgctttttacttacaccacacaacataaaaccttctgtcttgcactggctctctgatcctagcgtggaagacaaagagcgctgtccctctatgagaattcttcttattagtgcagatactggagccccttcaatatgaactagaccatgagttccatgagagtaggatgtgtgttcatagctgtacctagtacctagaacaatgctcattgaatgaataaggcaatgactgaacaaatgatgaatgtaccaagacattttgatagctactgagaaggttatagtcttgtttggtgaaatgaataatgaattaaacccgagttttccgcaaaagtttggactaagcagaaagtttatggtgaatgagttacaatctttgctcttctacttattatgtaactttgggtaatctatttagtaaaaggtgaaagatttatacgatctgaagagaaaccagagcatgggtaatctatttaatctctctaatctcaattttcttattcataaattagggttaataatgataatacctttctcataggcttactgtgaggaatgaaaaagataatgtttgtaaagtgcttagcagagtgcctgctacttggctgtaagaatttatgaagctgctgtctgctatgaggtgattaatcctaaaatgaaattttgtctcaaaagagagtcagaaaataccagcatctacagttgaggctttagaaaggcagaaaaatttaactagtagaaatttataaaataacttttgcattttcaaagattttagcctgtgatatgtactgataatgagttaccttcatgcctgctgtctttactaaagaaaaaaacacaaaatttgaccaagttggatatgcctcataatatatataggtacatatatgacattataaaaaatagcaagaacatcaacaaaaatgaatacagccattatatggattaaatgtccaaaagttataaaatgatcagaagtgtaatcacaatggtgaaatagagttttatttaagagaatcctgagatgttttagaatagcatgtatgtgtgtgacagggtgtgggggaggcactgagactttggaggatgagtggctaaagacttttttgggcatactgaaaaaaatggaaaaaaatggagctttgaccctgattaatatagtacgataggaatgctctttaccacttataaatcaacagcgaatgatggatgcaaccttatatcgaatttgctttgaatccttgtaacatagcagcaggcttgctatctttggtctgtaagttgtacctatatgttcttctctatggagggagaaagaggagattgtgctttatttcttcccgctgggttgtctccatgggtggattccccagccactacatcatccacattaaagggtcgtgatagactactattgctgggggtagttgtggaggttgtttactgcaatgtactcatctcaaccaaaagaaaacatgcatgcacgtacacacacacacacacacacacacacacacacactgctgaaaaaggtttaatcaacaattttctaaaaaatggtggtaagaaacacatgacctaaaatttaccatcttaaccattttaagtgtgcagctcagtggtgttaagtattttcgcattgtttcgcaacagatctccagcactttttatcttgtaaaacggcaactctgtatccattgaacaactccccatttccccctcccctccagttcctggaaactaccattctactttttgtttctatgaattggattcctttaaatacttcatataaatggaatcatacagtatttgtcttctatgactggcctatttcatttagcctaacgtcctcaaggttcaccagtgttgtagtatgtaacaggatttccttcttttttaaggccaataatattccattgtatatatataccacattttctttatccatttatttgttgatggacattgggttgcatcaattggctactgtatgaaatgctgcaatgaatgtgggtgtgcacatgtctttgagatcatgtctaagcggctctttattcaatattcccggtgaataaattcaaaccagaatggaatggggaaatatcatgaaaaagtcatcaatgtttgttttagtctagtgaattcctttctattcactaccaaagagtgtgggacctcactgccaaaatctctgtgtgatccctaaataaatgtttattatgcagaaatgccttttctttgtttctcataccacctaaacccattttcctgtatctcagctcttattattttggtacttctaaagttcctgctttatgtccccccttttcctggggtttgatctttcctcttgtattaggcaagttcatggcattctcttatatttttgagattttcaatattcccgtgagtgctctaatactctacatgtgtcactcctgtacatgtttatgctcttttgagtcatagttgtagagataagaaagaagaaagtagttggggttgaggagtaatctttactctggttgcagtaagctctttcgtcttcagtgtgtctaaatagataagtaatgagcgaatgattgactaaatgacatagtgtcttcctgggtttctgttaatctgacttttaaattggatggctaatattagaaaagtatgggaaaaagttgtttatcaaaagagacacgtaattcaagagttggtacccatatccttgtcttgatttcatacaagacaaaaaggttgaagcagcaatgtaagtttgactatgtagagtcaggattaggagtttcttctgtaccaatgaggaggtggcagggccagtgactaaggcaatggaagtcagcttggcagggaagctcagagaggcactataagtcactattaagtgccacagtgtatgacaaaaggcaaccaagaaagaacaaagaataggagaccaggacaaatagatatgtaccaagagaggtcaaaaagcaggtaagatgtttggatatcaggactgagacacaagcagcaaaaactgagtcatgtgtagaattcatggattaataatattaatattactattaagaattacaagccgggcacggtggctcatgcctgtaatcccagcactttgggaggccaaggcaggcagatcacttgaggtcagtagttcaagaccagcctggccaacatggtgaaaacccatctctaccaaaactacgaaaattagccaggtgtggtggtgggtgcctgtaatttcagctactcaggaggctgaggcaggagaattccttgaatccgggagacagaggtagcagtgagcccagatcgtaccactgcactccagcctgggcaacaagagcgagactccatctcaaaaaaaaaaacaaaacaaaatagaaaagaaaagatttcttaatttgtactggatactgttaagtactttccatacattgggtcattcaatccttactataaccctatgaggtaagtcctacatttaccttaattttacaaacaaggaaacaaagtctcagagaggtcaaataacctatgcaaggacacattcagcaattgaaagagttggttttcagattcaataatggcttctggttgtaggaatatataaattggactgggggagtcaggggataagtaaaatgtcacttagctccctgtaataagccttgcagtgcatttcctggtgtgtaacgggtatcatttatcatttgatcaagattcagtcaatgaccttgtttgcataaaggagatttcaacctaatttcctgaaaatctggtagttgcttctgcataatcaaacaaaaaggagtataggagtgaaaatcttaagtgtccaatttttgggagactgttttcaaacacgttcccaaacatagtcccgtacttaccaaaactgtcttaaattgttgtttaaaaatattttcactttagagagggatactagttttaactgttttacttttaaaaattagaaacatctgccttctaagccaggctttaaaaaaagttttactctcttatatctggcataaaagttttgaaaaatgagacattaggacagtgatcctagactttaaaacgtgagaaataatctcaccctgtgaggaggaattgcaagactgagaatgtggaagggaaaggattggatggaaagaattttggatttggtaccagaagatgcaggtttatttttgtttcctgcttaatccaaacctgaaactgagaatgataataccacattttcagagttattgtgtaatttaaatgaaatagtgttacacaaaatatactgtataaaatgtaaatttagtaaagcaaatggcaggcatttattgttgcaaccgaattactaatgttgaggctatataaataaatcttcaatacaacttttatttttcatactaataatgcttctatcaatttgaagagtcaagagaagtagctggtgaaaataagcatagcttgaaatatgaattgttagttggcgaagatgggccaagacatcacaccttctcttggagacaaagactaaattacaaattcttccacctggactttcagttgtgggagcttcaagtttcagaagtaacttccaagacccacgagagggagctcatgcacttcttaggcactactggttagctttttaatatcttattcaaaacaggcagtagtttgggaggtgaggtgtgatgaagaaaatggattaagggaaataaattccttcaagaaaaatcattggggaatacaaagttaactcctttagtgtggttgaaagtgtctgagaaaattctggctagaatcccttttaaccagctcccttaaaggaaaagtaactgctgcaatcatttccagattaatctttctggcttaacacccattccaaatattctcttcttagaaaagagcattgagagatgattatccactaatgtcatccaactccacttagcccaggctgctttatgagatagctaggaatatcacagtttaggcatttgtgatcacagttgaattcagttaatcatccagagagcaagagtagagtagaggtatatgcttacacatttaacaacatgcttattatctgatgtaattctgtggactgtcagagatgaagaaaccagttgtgtgtgtgtgtttgtgtgtgtgtgtctgactgaacgtgtgtatggtggagaattgggatgggtagaatgcagcatgaaacaatggcagagggagaggtcctcagttttgatgttattcattttatgacgtggcatacttctaaggtctacaaacatgatccaaaaggagatgtctaaaaagaacaaacccatctgcatgtaaagcaacatagtcaatagaagagacaaactttggctactagtattttattataaatattatattacaattgaaaagtaggtacaattataaatccagtcaatgtattgtaagtattaattatttcatggaatgcttattttccagaaaagctttttgtaaattgagttggtatcatataaaatagaattttctcattaaattttataataaaattgaaaatgcatttcaaagtatacatttttggctcaattcacattgaaattactaaggcaatatatcttttaaaaacaaatagttaaaggaaaataatggttgtttttcaccaaccattaacaaggacatattttgctattagtaaatcagtaatgaaacaaaccacaaaatgccaagtcatagggttgaagtttgaattaaatgaaatgcaatgagttcaagtttgttaccaggagagggcaactggctacctcccaaagtgtctacacaaaggagtattcactattgcctgtgaaatcagaacctgggttcatcaaccctttcaaaatgaattaatctttcagggaataatcaatatattaattaaacacaatgagaaatataccttgaattttgaaatcaatatgaccagtgaattgtttcataatatgaaaacctcccaggtatgttatgtttaatcaaattgttttatatatctgtacaatcagaataaaagggctgatttggttagctaaaagggtttttgcttttttccccccagctaagtgatttgaaagactgttttctactgcagggatagcttttcccatgggatagaaatgtttaatacctgggagccaacatcctcttccttggatgctgcttggatggccttggggtgtggtagagagtaggcacgactcttgctctcaactgatttccaatctagtgggacagcagacagtaaacagtaagtgaactaaatgtgatggtgagagtgctatggatcatataagaaaagggcgtttcacccaacttgtgtagtggggaagggtcaaggaataccttcaaaggaaaccatgtgaaccaatttcatttttatctggaaaattgtgcaggaacaatagatatctgtcttcaagaatgtttcaaacatagttggcaataaattccatattccatatgattgaaggtgtgagcaattattcagccacttgggcaggatcagatgatttgcaattcatgggatctttctcttaatattattcagtaattcacctcaacagcatttgttgaacatggcctcctgacaattggatgtggttcatatttcaacttctggcttttgttgatgtaggattcagcttactgcacagtcactattttgtggattagcttactattgataggtattactagtttggttaatggtttgccaagggaacctgttaatcaggagacaaaataatatatgactaataaggtaagcgaattacaaaacactttccttcaagtgccatatcaaacatatgtaatcaaaattgaactatcaatatatctgtctgcaaatatgttcctccacaagctccaccaggggcataatcatcatccattcaattgctcaggccaaaatcctaggagttatttatgattcttttcttcctacataatttatatctaatttctcagcaaatcctgttggctatatctcgaaaatatgtcccaaatcctgccacttcttctgatctctattgctaaaactttggtccaagccaccatcaattttcatccagacctctgcaaccagttggtatcttttcttccagtgtccctctcaccctacataccctgtcctgatgcacttacatacaataggcagaaagatcctacataatttcattccattctgttcagaataaaatccaatctttaccttggcctataagacctcatctggatgtgggccctgctgtctctcagaccttacttctcaccactcacaacagccaccctaatctgtagggtgtatcagagtgctctgtagatttacatcaagtctaattggatttataatgtttttaagttcttaatttccatgctgatcttgttacttttactgggactctatttcttcatgtggatttgagttactgcctaatggcctttaatttcagcctgaaagattccaaatgtcccttagactaaattcaatgtctgggtttcaggaacaatttcaaataactattttcctgagtatggactgttctttcttatttctttgcatttctcataatttgttgaaaaattaatattataaataatataatgtaagagttctgaaaatcagatttcacctctcccaaggttttttttgttattgtttgttgtagtgtaattgcctagcagtttcttcctgctcacggcacatacaaaaatcagtccactgaggctatggcattgcagtagagagtttaattgacatattgtgggcccatatgggagaattggagttatgactcaaattagtcttcctgaaggattggagcttaaagtttttatggacaatttggtggacagggagctaggaaatgggtgctgcttattggttaaggaatgaaattataggggtgtggaaaacagaatggttgctgctgattggttggggggtaaaactataggggtattgaaaaagttcctcctgtgctggttccacctttgggtggagccacaggatcagtggagtcataagtcatgagtctgggtggggtcattctgaaagatatgtcagaaaaccaatcttaggttcttcaatagtgatgctatctataggagcaattcagaaagtcacaaatcttgtgcttactggccacatgatctctgagcagtaagacattatagaaactatagctattttatgagaattcaagccactgttataatccaaacattgtaggcttttgttagttttacaaaggcagtttagttttgggaagggctgttatcatctttgctttaaggtaaaactatgaactaaattcctccccaagttagctttgtctacgctcaggaatgaccaagaacagcttggaagtcagaagcaagatggaatcaagtatgtcaaatttcccttactgtcgtaattctgcaaagacaatttcagtagtagttcttgtgtgtgtatgtgacttttctaaattgattatataaagtctgtattctttgtcatgtgtaaacctgaagtctctgctttgttagcttagttgtgagttgataattggaaagaaaattttttgagttcctgaaaccagcacgtctcccagtctttgccaagtggctgtctgtgcactttagggcatgaatttaacactcagtgaaactcttggtatcttgtttaatccacatttgctgcttacatacagcgtcttgagcagtctctgcatgtctttcctgactgagcatatgcaaaactgtgcacagctctggacatggatgtggacttctagattgccagggacatgtcagagctttcaaaacccctatggagattttaatccccagctgtttccttttcaagctttttggttagtctattatttctctcaattgttatcaactactttagacagctgcaaagttaatcacttgcctgaaattgttttcagcaacaccttctcatctgtggaaaaagagctttttgtactgggggaagtccaaaccaggtccagataggtcaaataatgaaagttctctgttaatggggttttgaaaggtccagctgtgttctatctttaaagtacaaaaaatgcagattgtaatttttcaatgctactgtggaattgaagagcaggggataggatcgggttaagttaaaacaccacagatgtcaccggtgagttgtttttcttgagtacatatttcatagattgccgcaaaactttaatgcccagagttctgaaaaggtgtattttgacattttttggtccaacattttgtttttatgaggagataaattttggaggttcttattctattttcacttggctgttgtgacctggctgctgttgatttctttatgacaattttaaagcctgctagtttatcaaattcttttatagtttgagttactattgttaatgattctctaaaggcttttgtaatcataccctctgctaacagagatagttttacttagtctttaccattttttatgcctttaattgacttcttttgcttaattgccttggttaacacatacatttcaatgttgcatagtagtggagacagtggtcaaccgttatcttgttttttgtgttaatggaaatgcttctagggttttgtcttagtaagatgctggcttttgatgtattttatcatgtgaataaagcatacttttattgttattttgttgaatattttatcagacactggtgtagaattttgtcaaaggctttaaagcatctctacagatgattaaattactttctcccttagatctttaagatactgtattatattaatggtctgtcacttattaatgatattcaatattgagtcagtttgcatttctggattaaattttactttcttaaagtcatattgtattttgtttgctaatattttagttagaatcttacatcaatatccatacattatatcaatctgcaattttgttttttatagtattttatcaatattttacttgattttctgtattttaaatgttctggaacaatttatgtagcattgagaccatctaatttttgaaagtttgtggaagtttacttttgagtcatcttttttggtactgtatggccaggtagttctttgaaaacttactgtttcttcctgagaaaatatccaagttttgccttctttttctgatgtggtcaagtttagtaaatgctagttcttcaagaacttatctttttgctttatatattcaaattaattatgtcaaggttacatagtggcttcttacaaaaatattatgtttaaattattgtttcttgttataatttctcattttaatatttatgatttctcattttattttggttcacccattttttctaaaaatgattatttgaagtcaattttctattctctgccttattaatttctgattttatctatatgtttctcatctcatgtcttcatttggtttattttcttgtttttattctacctctgtgagcttcaaatttacctgatttacttttatctttcatttttattggtcaaagtaataaaggctgtagattttcttctcatcattgctttaaatatgtctcacagatcctcatttccaatgttttaactatgatattttgggaaaaaatctgttattttggtatataattctctttgctcagaggagatttttaaataaaaataatttctggctgataagatggtttcacttattttttgagagaatttatcatgtgtttgtttggggatctgtgaattttacattaatatttttattttatagaacttactaatatcttctttgtgacttaatgtataatcttttgtaaatgttccataagtgcttgaaacaacagtacattttcttttatgaacatataaaaatttttaagtattcatttttatattgtttatattattcatatccaacccttccccttgatctctttgttaatgagtgtgacatattacattttcctattattaatgtgtttgtatttatatcttctttatgctttgtaactttttgctctttaaagattggtatattatgtaatgttgtgtagacattgcatcaatatttgcatagatattgtgttgttacatcatattttgaattgtgatttttagtgctaacagtactttttgcatttaatcattttatttttggtttaatttctactttgttatcagtattattatcactgatttcttattgtttttatttatttgctatattattgcccatcttttagctttccaacattattttgctttagatatatctcttgaatttgtatgtcagtcaacctttggttattgaggtttagcttccagtagattcctaaagaatggcttatgggtacagaatttttaaaactcttgcaatttaaaatctgttttctatagcttgatacttgaagggtataaaatattttattcatacttttataccttgagtttgtcgaaaatgcctttttattattactttgctttgtatgttgcttttgggaaatatgatggcagtctaattcatggtcccttgtgtgagtatttgatcattcttttaaaattggggccctaagattttttatttatatttaaatctatagtcttactagaatatatcttagaatttatcattgtatgtcagcattcccttgtcatcagtgagtccttgcaataaatagaatctgatatttaaatatatattaataaacttcttaagaacagttttaggtttctggaagaattgagtaaaaagggtagagagttgccatatattttctcttcttctcttctcccctcttctcacagttttttctattattaatatattgttttagtgtgatacatttgtcacagttgataaccaataatgacatattaactaaagttcataatttacaatagagttaactttttgtgttttgtatatctatgggttttgactaatgtatattatgtaaccaccactacagtatcacatagaatagtttcattgccctgaaaatggtctgagctccaccagctcatccctccaacttccaaaccatagcaactactgatctgcttactgtgtgtatagttttgtcagtcaggtattttatttttaattcttagaaaattttctttcattatagtttaaaatagtagttttgttacattatttttctgcatcagaaacttcaactgtgtatatattatttcttatttgcctgtctttcattttctctttgaaatttttacttactttttaaaaattctcttggccttttctctccttttcttctatttgccttataatgttttcattcaaatctgttcttttttggacacaagataatgtagacatttttctaatgtaatttttttctttttattgattttctcagtaaaataaactcttattttatgattttctcttttttgtccatttctgctcttagtttttgaattgctgattcagtgttctctcataccccccaatacttatttgaatatatttaattcagtttgaagtgttgtattacacatctcttcttcagcattttggggggaagagtgaggagaaacttttatcaactaactttgtttaattctcattttctgttttacttattgtagtatttttatagataaggactttttggtgtgtgcttctaaatttatataacaaagttaagagtttgagtaggttacaagatttctatttcaagatatcactcttctaactgtaggaaagttggtttattttatttttaattggacgtttttgagacagtagaggaggaaaaaggacatttggtatttattcttctactcacaggtcatttgaaatttgatattccttgtcttctaattgtattgagggagtatgttttctgtagctttatgatattgtttattctatttgggaagaaatggagaatattgcttttacatggccaccattgccttaactacccaaaattcttctcattttactttctctggtactttctgtcttgggttagtttatctgtgacataccttttgaaaggcaatgcccacttcccttaataaaataaaactttgtccctgagtgttatagtgagagggaaaggcttcatgtagaaagatcagctggaccatcataccccagtcttgaccttccccaaatctcacgttgaattgtaattctcagtgttgcaggagaggactggctggaggtgattagatcatgggggtactctctattgttttagcgccatcctcctaatgttgcttgtttaaaagtgtgtagcacctacctcctctcccttccttcttcttcagcaatgtagaacatactggcttcctcttcaccttctgtcataactgtaagtttcctgaggcctccccagccatgcttcctggacagcctgcagagctgtgggccaactaaacctcttttttaaaatataaattgcccactctcaggtagtcatttataacaacttgaaaattggctaatacagaaaattggtactagagaggcaggccattgctataaagatacctgaaaatgtgaaagtcactttagaactcggtaaaagggcagatgttgaaacattttagagggctcagaagaagaaaggaaggtgaggaaaagtttgaaacttgctagagacttgttgaatggtttcaaccaaaatgccaatagtgatatggacagtgaagtccaggctgaggtcttagatggagatgaggaacttaccaggaattggagtaaaggtcactcttgctatgctttagccaagagactgaccgcattgtgcccctgctctagggatctggtgaacttagaacttgagagaaatgatttacagtatctggcagaagaaatttataataagcaaagcatgcattcaagatgtggtctgtctgcttctaagagcataatctcaaatgcgagcacaaagagatgatctgaaactggagcttatatttaaaaaggaagccaagcataaaagtttggaaaatttgcagcctgaccatgtagtagaaaagaaaaacccattttctgtgaagaaattcaagctggctatagaaatttgcataagtaaagaggagctgaatgttactagccaagacaatggggaaaatgcctccaaggcatttcagagaccttcacggcagcccctcctgtcacaggcctggaggcctaggaggaaaaaatggtttcttgggccagacccagggccttgttgctctgtgaagccttgggacatggtgccctgcatcacagcagctccagctccagctgtggcttaaaggggccaaggtacatcttgggctgtgacttcagagggttcaagccccaaaccttggcagcttccatgtggtgttggacctgtgggtgtgcacaggattagagttgaggcttgggagcctctgcctagatttcagatgatgtatgcaaatgcctggatgtttaggcagaagtctgcggaaggtgaagagtcctcatggagaacttctactagggcagtgcagacagaaaatgtgggactggagcccccagacagattccccactggggcactgcatagtggagctgtgagaagagggctactgtctttcagacccagagtgataggtctaccgacatcttgcactgtgtacctggaaaagctgcaggcactcaatgccagctcatgaaagcagccattggggctgtatcctgcagagccacagagacagagctgcccaaggtcttgggagtccaccccttgcttcaatgtggcttcggtgtgagacatggattcaaagaaggttattttggagccttaagatttaatgactgcccttctgggtttcagacttgcatggggcgtgcagcactttgttttggctgatttctcccttttggaaagggagaatttacccaatgcctgtaccccattgtatcttggaagtaactgacttgttttgattttacaggctcattggtggaagggacctgacttgcctcagatgagactttggacttgaacttttgagttaatgctgaatgagttaagtctcagggaactgttgagaagggatgattgtattttgcaatgtgagaataacatgagatttgggaggagctagggacagaatgatactgtttggctctgtgtccccacccagatctcatgtcaaattgtaattcccagtgttggaggagggtcttggtaggaagtgattggatcactggggaggtttctattgttttagcaccatccccctagtgctgcttgtttaaaagtttgcagcacctccccactctttttccctttttcctgctccagccatgtaggacatgccagcttccacttccccttctgccatgtttgtaagtttcctgaggcctccccagccatgctttctgtacagcctgcagaacttgagcaattaaacctcttttcgttataaattacccttcatagcaatgtgaaaatggactattataagagattaatctttagttgggaatattttactgttactgttatcccactttgctggcctcaaaggaaagggtctcttccttttagcaagattgctaaatacctcatcaggcccttgatttagtatgcaggttcttaaaattaggacaatatgtgagctttatgtagtaataaaatttcctgaaataatatgcaaattttcttttctaccaaatgctgtgtatggatattatttgacttctgggttaaacaaaataattataaaaaatcttcttagtgcagttatggaaatctgatatggagttatattagatatatattagatgatatttaagaatttcacttgttaatttttatggcagtactattaggtattagaatatggtggaaaatgcccttaactactaagtgatgaatactgaagtatttaggaagaaaaatgccatgatgtttctaatttattttagaatacttgaacaaatatggcaaaatgttaatcattgataaatagaagtaatgaatgaaccattagcatcaggtttcttgctactgttcttttctactttcatggttgtctgaacataatcaaaaaaaaggtttaaaattgtgtattgtgtgatattttaggagtaggagaaggtacctagctttctaaaatatattttttagtttcttaagaaaagtcacatgagaaaagcaagggccagaaccactgactttccatagcacaagtacaaggctgctatattttagtgagcctgcaccagtctttacatcatataacatgatgtacaagatagcttgcagcttgcatctaccctgagaaaaccttcctactcagttttagatctcctccatgtgctccttactccattaacaaggcctgctgctactttccttcagaactagttcaaagaaaccaataaaaaccaaattgtttctatgcctactaagatctgtctctgatttctgactgaaatgatacaactttcctctcctgttaattgactttaagatgttcatctcatattcaagcaaaactacatctgtgccaaaagccactttatcccacaggtaccaatgggataatggacattgaaataactcaataacacataatataataaacacttggcatctgaaggataaattttttgaaatcctgtatttcctgttagcaatataaccaattatcttggttttcctgctgagggtcttcccaagatgcagaatttttattgttaaaaatgaaaatgctgggaccctgcctggtaggcagtaaaatctatggagtaagatccatatttgattttgcattcctagcaccctgaagtatattagaagaagatcaggtttttaagaaatgtatactcaatgtaaacataaataatttattatcatggttcagaaatgggataaaacaagagctagaattcacccacagactttttgaaaagatttcataaattgcagatattgcctaacaatggaattaggttaacccttattgctaagtgatctgagctcttgtcctctgtggctatgccctgcctttgcctattgctgcctctaagcctaacatatattcacaaaggtttaggaagaagatttttctcaaagaaggggtggctcattttcaacctaagttttaatgagggctttaacttattttatatttaattacatcaagtaaataaacacctgtattaaatacattatggaacaaggaaaatttttacatttccaataaatatttgaattcacttcaatgcatttgagtgctcactaaatatattgtgaattcttactaaaagagaaaagttagacaaaataggaatcacagaaatcctggatttaattgctgaatgataatctgtttacaagaggcctcagatcacattgacactatttacaattcactttgtttatacagaaggtattacccagcatcctcatatttattgatcagtataaacagtggtactggtatgtgaccaagaatgattaaaatgagcttttggttttgatcctttctgggtggtcttattgctttcttcttgaataacgatatatgcataatttgtaatgagtgtgtgctttgcataatgataagagtaaatgaggtacatttcagaattttgagtcgaaacaagaaatctgttttggattttgttttgaagttcccatttagatccaaagaattcatatttacaaactagttctaggaattagttcttaaattttatttgaactataacggtgccatgaatgttacacattttaccctagattgtaaatactttctttcccttcaagtaagtggatggacatatatcaacaccctaaatgcctaacctgctgatttatgaattataaatcataaatttaagaatcagattataggctaaactgtgtccatccccaaaattcatatatatttaagtcctaatacccagtacctcaaaatatgattgtatttggagatattagctttaaaggggtgaggcagataggagggtgggcactaattcaatctgattttcttttttctgcttcttgctgctgctgctctgctgcttctgcttcttcttcttctttcttctttcttctttcttcttcttcttcttgtttttaaaaagggtccaggctggagtgcagtggcatgaccacagctcactgcagcatcaaccctccagactcaagtgattctcctgcctcagcctcttgagtagctgggacccaagcacatgccaccatgcacagccaatttatttttatattttgtagagatggggatctctctatattgcccaggctagtctcaaaatcctgggctaaagtgattttcctgcctcgacctcccaaagtgttgggattacaggtgcgaaccaatgcatccagatggttttcttataagaggaaatttagacagacagattgacaccagatatgcatacacacagagaaaaggccatatgaggaggcagaaataaggtggccatccacaaaccaagaagggaacctcaggagacaccaaacctgcagacagttttgatctgaaacttccagcctccagaagtgtgtaaaaattaattcctgtttttaaatcaacctagtctatgattttctgttacggcaatctgagatgactaacacaaatcatttacctaagttttggccagttgttttacaagtagctttgctttctgtgtgaccaattcagggagcatctgtcagttagaatcatggccagattgagacatgcgtacattttggaaagtctagtaactcagtgtcccttcaaatccatattttaaaagtatttcttcaacatatatttgcgggaaggctgaccatttgagggacaaaggaagagaagaaagagtgaacatgatagttttcaatgaatcctctactacctagagatctatccctgactctgaactgtaatggagcactcaagtatataaagggtttacagtttgttgctctatcccaagaaggcagtttggcaatctgctactattacttgagcatatgccttgtgatggccttttgatgtgtcaacttggctaagctatagtgaattcaatcaaacactcatctagatgttgctgtcacggtattttgaagatgtgaataaagtgcattatctattgacttcaagtaaggggaattatgccagataatgtagatgggcctgattcaattcattgaaagtctttaaaaccagagctaagttttccccaaaagaaaaagaaattcagttttggacagcagcttcagcccatggctgtcagttccagcatgtccttcctgatgggccttctctatagattttggacttgcctcgttatccctcaccaatgtataatccagtttcttgtaatgagtctcttgatgtacattttctactggttctgcttttctcactgaaccattactgatataaattttggtaccagaagtgattctagaggatagtaccttaaggatgaggtttctgaatttgaccctgattttttggaattggttctctaatctaattagatttgtatttatgacactgttttcagtggtatagagggcatttgctgtttatgacataatgtggcaaaagacatatgcaaaatattgccatttgatactccaaatcaagtgcctagagaaggggagtttctgggtgatcatgtattggctaccttagaagattttatccgaactaagaagtatgatgggataactgcttgcttctaactgctctagagaaagtggggaaagagaaggatgagattagggcttcaaagttttagctcaagttccacataaacgatataaaaacttctgtatctgtcctaagtgaaattcttctcttctgaagctacagggctgaggtttctgaaaaccaaacctagaatctcattctgcgagtaatctgtattacaacaccagttgaactctcaacctttcaggttgtcttcttttaaagttaaggcatttccagcttcatccatgtccctacaaaggacatgaactcatcattttttatggctgcatagtattccatggtgtatatgcaccatattttcttaatccagtctatcattgttggacatttgggttggttccaagtccttgctattgtgaatagtgccgcaatgaacatacgtgtgcatgtgtctttatagcagcatgatttataatccatcattctcagcaaactattgcaaggacaaaaaaccaaacaccacacgttctcactcataggtgggaattgaacaatgagaacacatggacaaaggaaggggaacatcacacaccagggtctgttgtggggtggggggaagggggagggatatcatttggagatatatctaatgttaaatgaccagttactgggtgcagcacaccaacatggcacatgtatacatatgtaactaacctgcacgttgtgcacatgtaccctaaaacttaaagtataataattaaaaaaaaaagttaaggcatttattgggaagaaatgagatcctgaaaattaggctggagacattcatacagatcacaatgaggctggggatttttaacctctaaaacctgtcaagtcttttcaatcagtggaagtagccccgcaactgctgcttggaaagattagttctcttttttcatgaaaaacctataatggcactgctgttctcctcagacccttctcctaccacccctattagcctcaagacctaattttctatcattcctctaagaatttactgcaaacttcatggtttaaattatatacatttattatcttacagttttgcatgttataatcccaacatggttctccctgaaataaaactacgatgtcagtagggctgaatttctttctcgaggctgtaatagaagatgtttccttaccttttccagcctcttgaggccactcccatttgttgacttaaggtccccttcctccaccttcaaaggcagaaacagtagattgacttctttccttgctacccctctgggtttttgactgtagctgggaagtgttcttcacttaaaggtttgcatgattacattgggtgcttatccttaataatatctgcaaagtccccttttgcctgtaagctagcatatttataggttccaggttttaggatgtgaacatcattagggaagtgatttcattattctgcctaccacattcctgtggaagtggggagctgattcccatttcctaccccaggtagctgagcaattacttctcctacaaaaaaaggctgatacatttttctccatttggttacatttgtgtaaaatttgtatttaaaattttatgctttcatagcaaagtataatatagattgaaaaaagtacacaaaatataaatgaacatctaaatgaattatttaaaaatgtttctaacaacacttaaattaacaatattttcatcatccagaaattccttcacatccctttcaatcactattgcctttctttccccagaggtattcaatgtcaccaaagataagtttttccatgttctgaaatttacataaatggaattatgcagtatgtattttttctatcttctgtcttcactcaacattatctgtgtgagatttatcagtattattgcatgtagttgtagttcatttgttttcactgctgtatagtattcactgtatgactatgccaaaaaatgtttaagctaatatcaggggttatcagacttcttctgtaaatagcaagataggaagcattttaggcattacatgacttttttttcctgcaatgactcaactttaacattgtagaacgacagcaaccatagacaatgtgtaagtgaagaggtgtgactgtgtcaagaaaatttacaaaataagcagtgggtggatttggcttgtgggtcacacttaaatatttgggttgtttctagtgtgaggctatcatgagcagaactatgaagtttcttgtacatgtctcttggtactcctgtgtatgtgtttctattacatatgcagcaagaagtaaattgctttttcagctttagcaaatgctatccagttttccaaaatgacttttaggaacagtgtagatgctcgatgtttttatcaacacttgaattttacagttaatattaggttggtacaaaagtaattgtggttttggccattacatttaataacattttaggcattttggtgggtacataatggtatttccctaaacctttttctgataagtcaactgggaaaatcaggggtgcatactgacatttgaacatataaattacattgattattcttgggtttgtattattttatgcaaaatatgatctgaaatgaaattcagaagatttaggcactggaattaaaaaaaattactagaatttggcctggtattgagaacagtgacatttaaaattaaatgaaagagtgaaagctattaagttgctttcacctgaacaatttttagtccttccgcgtggtataaactaaagcaaaatgttctagatttgaaactagttctaggtgtatagtatttaatatagaataagttataacaaattgaatgagcttgaataagtcacttaatagcattattttaaagtagaattaatgtctgacaaacctattccacacgacttttgtgaacagaaaatgtaattatgttagtgataatttaaaaatatttggaaagaattaaacttgattaagatgctttatccactaaggacaccaaatcttaactgttaacaatctccaaggtcctacccagttcacatccatctataaaagtaattgaaggagttctttcagtcaaaaccctctcatgacaacaaaagggtctattgagactaaggaaagacaaactgcacagcaggaactacatttgtgacacagctaggcaatacataaatacattatcctgtgaagtagagttttggtattttctagtttttctttttcacaaagaaaatgaaaaagttggtgagaaaagttggtgattgagactaaggtcgtgcttctgttttggtgtgggttcatcttttccctgagtgctaataattcttttttttttttttccaatgaggtctgatgcctcattgcttaattgttttataatattgttgtagattattcttagactgtgcctaagttattgtttgaagttcaactctttgttatttgtttttgatgtgtgattctttcattaaaatctgtatagttactaacactatgttttttttttaacacgaagtgacattctttctcctaagttttttttttttttttaatattggctttctcactgcagttattggaaagtctatgtattttattctatttagcaagcacaataacttacttgtgcaggaatcaacctgataatttatttatctccaaccagggggaaaatcctatgaaaaatcattaaacattctcagctcagagtgtttgtttttgaccatttctcctcaatattgtctagccttcaaaaaataatttgtaaactttaaagtgttatacaaatactaatttataatattgttaatcttattaaactttgaaagacacattcctttttctcttgctccttaaaatactttgatccttctgcaaaaccatgagaaaaagccacagtgatgaatcctagaccaacaggaggaaagaaatttgtttcttctatttctattatttccagatttctacagatgaatgctataaaataattccaacttccaaagttccatgatttccttgcagttgcaaattcaatgcattttggggacacaaagaagcctgagctgtgaggtttctaatcttgttcttgctttttaactcatccttggtgaagcattttaaatttgcacaagttaggttatagccttcaagagctctggacattaaagtctaacttggtttcaatatgtaaattttcccccttatactagtgaaattcacactcagggtctgcttaattagcttcatttttaaaagcctaacatgggatcatcaaagtaacaagtctcaactgtacaacttgacatctcattaacacttgctttataacatatggtgcttggatgatctgagttaatgtgggtgccagtaaggtggtggaggtgggcataaagagtcaaatttttatgtcatttgacctgttactttaaataaaatattcgttacatttactgagcacagtatagagttatgaatgtaatagactctctaggtgtagttgtttagataaattactatgtaaatgatcttcaaaaacttgaaacatgtttgacatcacgtatgatagagcacaatctaatttgatggattgttatgttttgacacattttttacaatgataactgatctaatcaactgtattacctgcagattacatgtagtatttatagttataattatttttctatagtttctacagaaaacttgagttctttcttcatgccttagattcagtattttgacaaattgccaagctacaaatttaaacaagcttattgaaaagactgtgtttacttaacttgaaatatgctttgttttatggaataggaaaagaagaagaatgggaaatcatattgctgtttaaaagttaagcctgtattagttaagattatactaattaaaaaatctagatgtttaagtgcttttattttactattcataaatacttttcacttagtctgcatgataagtacttcactgtactctaaagcctgaggcgaccggatggtagaattacagaatttggagctcagagagacttagagactcacagaggtcacttaatttgacatcttaactttacacaggtaaaaagtaagcctcagaactgtggcttatatttgtaaaacatcagtttctttctttatgaaagagctatagacagaccattgagtctatgattaatagatagagaaaactgatttgttatggcattgcatttagcattctgaacaaatgaaaatagaggcatggtaagagttatgatacagagcacattaaggtcccaatgccacaagacatgcagtaacattactgtaggaaatgatttctaagtctcagagaaagaattgtcatttcctaagtaactgtaatcagttttcaaaaatgagacctaggatctcaagcggtgtattctgcacagcagtatattccactatggataaacattaactatactcttgtatcatgctttctcattctttcgtttcattgctttacctgcttaaagctctatagcttctcataaatctttgaatgctataatttactttttagcattgtttttagatcaagcactgtttccttaagaatacatgataaaatttcaaaaatttcaaagtaattctttcaagtccagcattgtttaatgcaatcagaatgttgtgttttttaatacagaaattattcttatggaaaggttatgatttgggaaagaagaaaaatagagacaggccacatgatatcctaaattctttaagatttattcatttagtgtttggcaatatggaagcaaggaaggagatcttaggatttacagaagctccagtagattttcagcacttagataaatgacgcagatgtaaaaaacacaagagtaataatttgattttttattttttctttaattcatttacatttgcagatattttctattttcctaacgttataaacagggcattttgttgtgagaaagtttgggaaatacaaaatataattgaatatatttctgtaattataaagaataaaatatgacgatttatcttgaatatcatggcaatgatttatcttgaatatgatgaaaacatgacaatcatttatcttgaatatgatggaaactttgatgtgtaattattccttccttttctcccatctcaacttttttttattatactttaagttctagggtacatgtgtacaacttgcaggtttgttacataggtatacatgtgccatgttggtgtgctgcacccactaactcgtcatttatattaggtatttctactaatgctatccctcccccattcccccaccccacaacaggccctggggtgtgatgttccccgcctgtgtccaagtgttctcattgttcaattcccacctgtgagtgagaacatgcggtgtttggttttctgtccttgtgatagcttgctcagaatgatggtttccagcttcatccatgtccctgcaaaggacatgaactcatccttttttatggctgcatagtattccatggtgtatatgtgccatattttcttaatccagtctatcattgatggactcatctcaatttttttatgtcatctgggatttagatccagagtagtaatatttcttttaagtgattcatgtttagatataattttgatatttattttgaagtttaagaactttattaatacattttaattacaagatttatcatatttataattgcaaagagtattgattatcagtattaattctttaatactgaaatttttatagttgaattcttcatttgggttcacctcttagctagaatatgtctgagcaatttctcagcaacagcatatagatgtcacactctctgagttcttgtctaagaaaagttttagcaacttttgaacatgtgagataaattgattggacatacacttcttgtttcagaatcatttcctccacaaatcattgattcctgttattttatcccatagaagaaaagtcttattccaaaccaattgattttgtatctttttaaactaatttttttcatttatttgctgcaattttaagcctttttttaaagtgatcttttttttaaaaaattgtactttaatttctgggatgcataggcagaacgtgcaggtttgttacataggtacacaggtgccatggtggtttgctgcatccatcaacccatcacctacattaggtatttctcctaatgttgtccctcccctagccccccaacccccaacaggacccagtgtgtgatgttcccctccctgtgtccatgtattctcattgttcaacttccacttatgagtgagaacatgtggtgtttggtttcctgtttctgtgttattttgctgagaatgatgattaccagcttcatccatgtccctgcaaaggaagtgagcttatccttttttatggctgcatagtattccatggtgtatatgtgccacattttctttatccactatatcattgatgggcatttgggttgttccaagtctttgctattgtgaacagtgctgcagtaaacatatttgtgcatgtgtctttatagtagaatgatttataatcctttgggtatatacccagtaatgggattgctaggtcaaaaggtatttctggttctagatccttgaggaattgtcacactgtcttccacattggctgaactaatttacactcccaccaacagtgtaaaagtgttcctatttctccacatcctctccagaatctgttgtttcctgactttttaatgatcatcattctaactggggtgagatggtatctcattgtggttttgactgttatttctctaatgataagtgataatgagcattttttcatgtctgttggccgcataaatgtcttcttttgaggagtgtctgttcatatcctttgcccactttttgatggggttgtttttttcttctaaatttgtttaagttccttgcagattctggatattagccctttgtcagatggatagattccaaaaattttctcctattctataggttgcctgttcactctgatgatgatagtttcttttgcttggcagaagctctttagtttagtaagatattatttgtcaattttggcttttgttgccattgcttttggtgttttagacatgaagtttttgcccatgcctatgtcctgaatggtattgcctaggttttcttctagggtttttatggttttaggttttatgtttaagtctttaatccatcttgagttaatttttgtataaggtgtaagaaaggggtccagtttcagatttctgcatatggctagccagtttttccagcaccatttattaaatagggaatcctttccccattgcttgtttttctcaggtttgtcaaagatcagatggttgtagatgtgtggtgttatttctgaggcctctgttctgttctgttggtctttatatctcttttggtaccagtcccatgctgttttggttactgtagccttgtagtatagtttgaagtcaggtagggtgatgactccagctttgttctttttggttaggattgtcttggctatgtgggctcttttttggttccatatgaaatttaaagtagagttttctaattctgtgaagaaagtagcttacaataagtcttttaaaatgcaatactttttaaacaatatttataacattgttcccattcactgtatacctaaaaattgatatacacttgcttccatgttactgattactgcatgaataaatcttaaagaattcagtatatcatgtggcatctatttttcttcctccccaaatcataacctataaataggaataatttctgtataaaaaaagaacattcttcttactagtacttggtacttaggaaaccatttttaactgaagagtcgtgtctcactttattccagtaaatattgttttattttttaactactgagcatgctgtcttactatccatacacattgttgtcacccaaatctcttttctttcatcatgtttatttacctattaattttgaattctgagaaaatttcaaaagtttgtcttgtaacatttaattgcattatctatgttctcgtatgtgttgtagttgttatatactgtctccattgtatttattaatttaacaactgagtttttagcttccatgctaatctcacctattttcatgactgcctactttgatatcagaaagtacaatattttcttgattattgagaacatgaattgaaacttttcttgcattagcctcctgcttcttgctgttcattgattttattaaaagcatttcctttgattttttttacaccattttccttttctgctgtttgtctatcttgatgaatggagatagctgccattccaacactcctttggccttctcctggtcattgaccctgaaggaagctccaccctactggccttggcctgacattttgtaagccctctcagtcctggtttcagttagtttcctctacttattgatttctatatagaattctgtctcattcaggctacattttgcctggcagaaaaccattatatttcagacagatggatacaactctagttttcacagctgataaaaattattgcttatttttttattctgtggaccccatgcttcagtagggaggtctagtaagatgcctttgtgtattattatattatctagaagtatccagtattttctatagaccaattactctttaccttttacatttgagtagaataaacagctatctggcctctgactatctggtctgtcagtttctcatatgctgtaatctttgtattttactgtccagccataaagaaccaccaactgtttcctcccaaaccaccattctattatatctctgccttaaatgtgcctggaacactcctgaaaatttacatccacaaattttcagataaatgacttttcatcttttcctaggtagatctattcttcactacaataattatcctattgcttagtcattgtttatatacttggcacatggaaggcatttgaatgaatggatggatgggtgggtggatgattgaatggaacaagcctgtcataagcactttggacaagcaagtcaatagattatgtttaactaccgagtatagaatggtgtactgtggtcatcaggtcacatgggaaagcatctcaagaagcaaatccaacaattgattgcaaacctaatggttattgatctactctttaaagaattaatgctggagatataaagatttagtagtttacagcctcacacctcttttacatctgtcagaggcctcatatctaaatgggactaaaatatatgatggacctgtgttgaaatctcacatccaatatttattggtaacatgacagtaggcaatatttgagcctctctgataattaattgtttcactttgtttttaaatccgcaagtaggcataaacatgatagatacatggtattgttttgaagattcctttctcctctgtaaaaatataaggaaagtatattcttttattcatattaattttgtgagaaatttatatctgaaaataaactggtgtcattattttcacaaaattagaaaactcttagtcaaatctcaaatttgacatgcgcttttataataaatgggaaggataacctatacattcccttagctatggtgtgtgcacattattcaaagtttactgatcactaatatttattggtgaagtttcaaatggcctgcccacttggtgcgtcatttcatagtaataatgaaaataacagctgtcctgttttataacttatagttttcaaagctctttcacacacatttaatcctttgatgccagctggtaatgaaatgttttctaattattatgcatcattgggcagggtgagcctgaaggccaaaagcagttaacaggtattaattatagccattcacttttctctgaactttcattgacactcccacaggttacaattcttaaatcttttaaagatttgattcattcagtttctcctatattgatttgtcttttaaatataccatatagggtccaatttttaaattcttgtggctcaatatatggtgtttcctactgtaagtaatatcatgcagattgcttagatttccttgttttctctggagcatgtaataatttgcgacactaacagaataaataaatttaaaaaatggttattgggactgaaaatagttaagaaggactatttttatacagcccaggcttacagatacagtatagttggccaacatgatattgatgtggaaattataaaatatatgaatcattgtgaattacaaattgaaatccaaatagctatacaggactttgtggaggcattgagttcagaggctgtcaacctttcccatcttatggaccccagtcatactaaaaattgagtcttaccatcatgggaatgaaaaattctttttcccaagcaagatgaatcatatttacatgcaaacttttattatatgtgtattttatggtaaataaagtgacataagatggagaagcatttacattttgggtagattttagtgctatgatttatgctaaatagatgaaaatgttatcccatttgaagttgaagactagaataagagtgctcagcatacatttcataatacctaagtgcaaaacaaaaaagagaatcaacacaaaatgtcgtaattattttttcagatcaacataaaataagataacatagggaatacattctttacaagtgccgtgaaaaccctacatcttagctagactacttttgtgtctaactggtagtatgtatattttgtacttgatgtttttatttcctcgcctcttgtgggacattgcatattggccttaaaccttaaccttttccttcccatgctccttatatttgactgtgtttcctcatattaaagaagcagggcatgtttctctggcccttgagttttggtttggccatgtgacttgctttggccaatagaaaaagtaaggcataacagtgtatcggctcagagcctaggctatcagtgaacttggtggctgccccaagcatgcccaactctgatcagctgatttccaatgggtccacaaatgtatgagtaagccaatctaactaaatacactgcctatctatctagctagctacctatttctttatgtatctatcttctcccaaatttgttgtgggttaaagcttaaaatttttatgaatctggattccttacaggagagtaagaggttatttatctaacactctcctgtggactgtgaatagaaagaaggcataaaattgtacagtaatctaaaaaacataaatatacatcttcttttataaagataacttccaatgtcaaagcagcaaggaatagaggcaacatttttatttaatatttcagatagtcttgatgtgcttcgtggtgtagaagataacctggacacatcccttatatctcaaaattaattaaactaatatttattgaggacatattatgggccagaatatacaagagaaactggatatatagtgatcaacaagagacacatgattcctgccatccgagtttggtggaaaacactgatattaatctgtaaatgcactaataaatacataatgactgattttggtaagtgacataaggaaaaatataaaatgccatggaactttgtaggatggagcattcttatagagtatagacagaaagggcattaaaatgacccaaaatctacccaaaatgtaaatgcttctgcatcttatgtcactttatttaccataaaatacacatataataaaagtttgaatgtaaatatgattcatcttgtttgggaaaaagaatttttcattcccatgatgataagactcaattttcagtatgactggggtccataagattggaaaggttgagagcctctgaactcaatgcctccacaaagtcctgtatagctatttggatttcaatttgtaattcacaatgattcatttagcaaaatttgaaaggtaagtaggatttaattagggtagaaaagtgggctttagagaagtgcattgcaagctaaggagtaatctgtgcaaaggttcagaagaaggaagacacattgtgtgttcttaaaacttaaaaaaaaaggccagggtggctagacagtgtccagtgagaaacagagacctggaacatggctggacccataggcaggacacatattatacaggatcttgtagaccatgtaaaaatgtgagactttatcttaagttcagtgggaagctgttaaaatattttaagcagatggaattatattccaattagcattgtaaaagatcactctgggtgcagtgggcaaagaaccagagagagaaaaatggacatagggagactaactgcaaggtggtagcaattgttcaggtgagtgatgaagatgacttagactaggatggtaaaggacctctggaaataagctgcagaatttcatggtaaattggaagttggaggtgcttaaataaaccattgctgcacatcaaacacctataaaatctcaatggcatataaccataaacatttatttagttatcacatctgtgagctggctgtctacgctgggctcagctagcagctgtgacacatgcctttcttattctgaattgttacacagttttacttatcacatggtaggtttttgttattgttgctgctgttgttgttcatagtgctatcctttatcttttcattgactagattgtagtttattgaaaatataaatcagtatttatcaaccccccactccattttttttagatacaggttctctgttgtccaggctggagggcagtggggtgatggcaccatcacagctcactgcagcctcaaactcctgggttcaagagatcttcctacctcagccttctgagtagctgagaatacagacactcaccatcatacccggctaattaaaaatatttttttagtagaaatggggtctcattatgttgcccaggctggtcttgaactccattgtttatatacttaaaaattttttaaatatagttaagcattgactaaataaatggtaagcccttaaaatatgttttatctaccaatttttataaagcagaatgattgttcagaatttggaaggggtatattgaattgacttctaattgattgattgattaatacattaatgtatttacccagccttttgttgagcaatcattgtctaacagttactgtactaggccctggggatgctgaaaattccaaaatcttatcaccattcccatggaactcagagtcttgtaagggagagggatctaagagatctacaaaggaaaacaattatgtgcatttcagaatctaaattattacttgactattacaaaagtcacatttaaaatatgctcttgcaaaataactattaaaactttagaccaataagtcttaattatatagtctaattgcagtgaggtttgttcacatcttctcagagatcagttagcctcactccaaactcctgatcaatagcttaagtttaaattcaaaatctcctcacttgtgccttctgcacacaaagctgtacctttactctggtccccatatattgcttttggcccattcatcaccaaagaccaatactcggtaaataatgtggaaatcaactttatccttaagaaggagctgaaaatcaaaatgcaagaagagaaataatttgacaaattctatctaagttcccagatgtctcctaattctaggcattatatgagcatggcaaaaggccttaaagctaatacacacatacaaaagaggattttatgaattctaattagaactaagaaagaaaaatctttcttaaagagattttataataaaaaagaatgatatcgttttttgtttcatttcccaggtattatgtaacattcattgagtactgatactgaaatcatacaaatacttattttcaactatttttgttccgaagatttacaacaaaataaagtaagagattatcccatctttaattttttaagaaaaatcataagattaccccatctggaatgttattttatgacaccaatgaataaattgggtccacagaagaatgccaagtgcattagctggtttgtgtactagattatgttagaaaatcttgccaagtatgagcttgatggttttccaggccaaaatagagggaaggtttacagcaattatttttgttattcatacttcaaattcatttggtcacaaatatccaagttattgaagctaaatgagaacttctattcatggaataagtgctaaaatgatttaaggtctagtgaaaagctggggtaaaatttaaaaagagatggctaagtttttggccaatgttttttccaatgttttattttttatttaaatattttgctttcttaattttgaaagcaaaaaaagaaaagtgattctacatagttgaattactgttgaagtgcaagtattatgttttaaagaaaatcattgatcacctaagctttatctatgttacaatttcttttaagaaaatttctatgaggaatggagaaataaattttatttgctaggtgaagcttataaagttagagaacttttattagctaatattcaaaggcttatttttggcctttggatgcctataagacaaagcttatgtatcttagctggtaactgcatatagagagatgataacttaaaatttgctgtatgccttttaagagatatttccttatcaaataatagcttcctacacatcctttcactaaggtaaccaatgatgtttgtaatgttcaaaacaatagacattaagtcctcagcagacattaaaatccttgatccgtctcttcttgaacttttctgttctgttggatcctataccgttaagttctttctgatttttctatcatctggccacctgttctctgcgtcctttcaagttcatcttctgtctgtccattaacgttgatatacctcaaggttctcttctttcctcatttcctatgggaccttctttacatcttcagttatctttgtgcaggtgatatgtatttatcgatcaccaggcctgatttttcctttcaattccaggcctgaacttcatcagcctccttgtcatcacttcatggatacctcacagacatctgaaaataagcatgttcacaaccaaaatcataaaccctccccaagattttatcatctttcaatatcagtggatgtcaccactattcaacttcttctgtctcctgtagacccagtggtcagtcttacattgcccacttcctcacctctatattcaactcctcactgtgtcctgttgatttaacctcttagttatctcacaaatccagccatttctctaccatcaaaaatttagtccaaagtgatctataatactcttcttgaaatggtataaacaggtatttttattcatcattacctatgcatttacagacattctctttcacataaacacgcacactcatatacatttgaaaagtaaagtataaatgagatactaccacacacattatgaaatgggttattagtttgtcttgatgactctttagtatttgtcagtctatatagctatacatcattatactacgtgcattttattccatagaactgtcatgccgtgatttatctactctctgatcaatagaaattattaattaaaatcaggaccaataattatagtgtctgctaaggatttaaaatactatccattctgtgaaacattacaaacaccactggttaccttagtaaaaggatgtgtaagaagctattattagataatcgaaatacctgttataaatgtacacagcaaaatagattgatttgatttatttactcttaagagaatgtaaaccacattcatgcatgtggtttacaaaaacgttaaattttgatagatattgacaaaagtaccctctgaaaatggtgtgcccttaaactcacaccagtgtgttatgaaagtggctgtttcaccaaaaaacacatgacaaaatgctcatcatcactggccatcagagaaatgcaaatcaaaaccacaatgagataccatctcacaccagttagaatggcgatcattaaaaagtcaggaaacaacaggtgctggagaggatgtggagaaataggaacacttttacactgttggtgggactgtaaactagttcaaccattgtggaagtcggtgtggcgattcctcagggatctagaactagaaataccatttgacccagccatcccattactgggtctatacccaaaggattataaatcatgctgctataaagacacatgcacacatatgtttattgtggcactattcacaatagcaaagacttggaaccaagccaaatgtccaacaacgatagactggattaagaaaatgtggcacatatacaccatggaatactatgcagccataaaaaaggatgagttcatgtcctttgtagggacgtggatgaaactggaaaccatcattctcagcaaactatggcaaggacaaaaaaccaaacactgcatgttctcgctcataggtgggaattgaataatgagaacacatggacacaggaaggggactgctgtggggtggggggaggggggagagatagcattaggcgagatatctaatgctaaatgatgagttaatgggtgcagcacaccaacatggcacatgtatacatatgtaacaaacctgcacattgtgcacatgcaccctagaacttaaagtataataataataaaattaaattaaaaaaaaaaagaaagtggctgtttctccctactctccttaaaaggaatattttcaaactataatttttatgtaatttgatgagtaaaactacatagcaattttgttttagtttcaatttctctgattactattaaggtttagtgtaatttcatatatttattataaagttttctataaattatttatttgcatcttttatcaatttttactacctttttcttaacatagggagtatatacatacagtgataactactacattgtctcttaaagattttgcaaatatctctccatattactgtttatcataatcattattattaacttttgtcaaaaagaagttttaagatttttatgtagtcaatctgttaattattttctttaatttgtgtttgttatatatttcttaggaaaccctttcccaatcctcaatattaaaagtcagtagtccatgaaaaaaattataatttgttattcaatcattctgtaatttattttgtgtatttcagtagggttctaatctaatattaatgtatgggatgaactggacttatttactaaaccagtctttctctgctaatttaaatttccattttttcatgtattacacacacacacacacacacacacacacacacacacacacacatacacacatgtaccttttttgttttcaagtcttcagtttgttccagggatctattcatctattcctgtattcctgtgctaatacattgtttgcatttttatacctttatggtatgttttgatatccgttatggctagtcaccccaattgtccctcccaaataaccttgtctagttgcataaaaatcctaatgtgattggtttgggatcatattgaatttataattattttatggagaatgtttgtctcttcaatgttgagcatagtgactcttggatgtgcaatcatcattatgcttgagattccctgttcatctgtctatggatgacatttctgtttaggttgctaccagtttatggggaaggtgtagaacatgctgctggttttgccactagttatctgccaggaatggggacgtcttatagtcacagctatctggagcaatgttctcactatttttgcctcagtgctcataatcctggctttcacctgggtataaatgtcactgacttttgcagttctccaaagattcacctgatgctttccccagagcaaatgtgatgtcctgcatctactgactctggctttggaggttttccaaccatttctatctctgtctgcaatgattttcattttcacatctgtgtattttgagctatgctttcttatgtttttgactttctgagacataactccatcaacgttttatcattcaggaaattgtttgcttcccaacaatttcttgaattaaaaaaattctgccattttttggtaattttcaatagaatggtgggtaatattttcagaaagtcacttaaaatagtttctagaataaagatttagtaagacccctccctgttaggttcagtagctgtaaagcaaggatgatgatagactttttaacaaggctgtttggagtttaattaaatgagacaaacatgtatcttatcataaatatactgaggcataaaatgcactctgtaaatattaaataacctcctttcccctcaaccttaacaaaaactaaacctcatttaaaaaaattccaatccaaggattggggtgagtattattggtatagagtagatcatattttgaaagcatctgcagtatctgatttttctcaggtaaaatctactaccagaaacactgcaggcagaatgtaagtattccagattggtttgaccccttggctataatctaatagcaggaaaacttcaagagaaaaatgatattagggtattcccaagaaacaatagtgacagtgtttgtactatcaagcttcttctctgttgtgtagctgctgcagttgcaattccttacctcaatgacatctcagtgaaggtaggtcccagaacaacaattaacacatcatcacaataaaggccatgaaacaacagtcacctcaatgtgataatatcatacagtgtcttttaaagccctggtggttgattattttaattaaaatttaaaaagtgatcatctgtcctgtttgtaatcataatcaagttgttgcatgagcttttcaaaatgaaaattttacaactacatataattttaatttttcagtttttttaaaactcagacttggatgtacataaaaagtgaaggcttgtagcagatattaatatggccattaccaatgagaaatagagaagttgagtgatggtccttgaataagagcatggtaagtcagggtaaagcatagatctatgatggattttttttggcttttagactagcattgttttccccctctgatctgtactgctgcttttcttttccctttttcatgtacatgaaggtcatttgctgtgatgctaaatattgcacattctgtcctggcagagttggcacccaaatcaaaacataaataaatacagtaaaaagaaaaatgaagggctgtacgtgtctggaagtgtcttcagtgaatctgaaatttcaaggatgacttggaggtcccagtgactcatgaaacaggaatgttagccaaccctgatgtaatattttatatgaagggcttttcatttacaaaggtctcagtatttagcaaacttagctatcctaaggcattcatttcatccttcacagactaatgatgtgcaaataagattggatggacctgagaagtcatttaacatacagcaagtgtttatagcaactgagctaagtggataaaaaagaccctgttcttttgaaactacagggtaaggctttaagccagcagccacagtgatccagctcagctgactctgtccaggattctgggctacggggaacatgaccatgggccaactatatttgctaaccacacattaaaagttatgaaatgtttatttttggctttttcgtctagggaaagttaaagatcatatctgtaaccaaataggcttatgagccctccatactttaggccttctctgtaaccctagtctgtgcaaacaacctcagttttatcccttttataagggagaagagattatcattctttattggtgagctaccataagtactgaattatattcagttggtaacatcagaattgttttgagctgtctgcttttgtgagtctaatgttttgaggaccatctgtctgcctcttggagaccatggtcttacttgattctgttgatacagttctttcttcttgaaaaccagcatgctagtactgtaggagaaactgccgatgtcaggtttttaaattgtattagggaacccactctgttacaacccatcccatgtgcctataaatgtggagcacaggtaagctacacagatgtaaaactttgtttcatgtagtccatctggtcctcaaaagaaattttttcattttgaattaatacctttctttctttctagaaatattcagcacattggctttttgtgttcttagttttgttctggactctattcctaaagtcagattaagttagaatatacatatgatagaatctcactggcttaaatttatggaaaagggagagaaggggaatgtcactgagaagtatggattattttaagtgaaatgcagctttactgcattgaagtacatttggcaatgagaatcaagctaataatcttttagttgaatgaacaagaatgcactgtaatttcctcaaaatttgacatctccacaaaagttatggtggaacataaaatttagcccggagtttcctgacagctaagacaaaaagggaaaactcttggaatatgtattgctcattgtcaaataagaggaaacacacaattttctgagcagggacactttactgacagtgtactgaaggtaaagttattgctgtttatatatttactagttcaagtcagttaattaattctcttattttattgagcatccagtatatggccaggcattgtgctagatattggggtttatagactaataagacaaagtacatatcctcagaaagctaacagtctatataaataaaacaatgcgtaatgattttataaaagtgcaacttaattcaaatggtatttttctttttctgtataaacctggggagattacattaaatctgaatttatgaacgttattccttggacatttgagacagtagtttgaggaccacacattcagcctagagcatggagagttggaaacaatagtttcaatgttcattgcactgtttttcttatatatcaaatatgtaaaacaaatttttggtaaaatttggatcccaggctagtcatgacttatttttgaggcatgtgcctaggtcttgaatattatgtgttggtgactgaagactttagtacacatttagaaagttgactttcaattttcttgtgaaactttgaagagttcttgtggagtttttttgggtttttctgccaagacattggaacagtcaccatctgttcttcctggaactcatgaggatcaatagaaaggacaatatttttccccagtaagatctctgaatgtacttgagcccttggacatgcgcttggttgacttcccagaaatctgtgccatatagcacagaaaaagtgatttgggataatgtggtgacatgattattaaggtcaggaggccataccttattcatgctgcatttttatcacataatatactgcctggtatacagagctcaataaatgttcgtggatagcagaataaagttaaaaatagaagttagcacagtataggattaaccacattaaatgttcaagtaattcaattattttaatcattaccgtacaaatacaaatcttgctcataagaaatttacagtctgggtgcagtggttcatgcctgtaatcccagtactttgggaggccaaggcaggcagatcttatgaggtcagaagttcgagcctggccagcatggcaaatccccgtctctactaaaaatacaaaagttagctgggcatggtggcacaagcctgtaattccagctactcaggattgagaggttgaggcacgagaattgcttgaatccaggaggcgaggttgcagcgagctgagatagcagcaccacactccaacctgggtgacaccagagtgtgactctatctcaaaaaataaaaaaaataaaaataaagaaagaaaaagaaaaaataaatttacagtgttttttggagggtggacattcaacactgtagaggggaatgtactaagtagtggagaagcacaaaatagagtaattaaccttgcctcaacagattggggaaggctttgcactctgaagtaagatggcatttgaactgtatctttaagaacaagaaaaaattaatcaggcagagaaagatggaaaagtattcattcagtgctatttcaggtatctattgctgcaatatcaaaccccccaaacatagtatcttaccacaacagttatttattttgctcataaatcttcgatttgagcaggacttgacagtcacagcttgtttctactcagtgtggcttcagctggagtggctggcttagtaagttgttggccagttgttggttggcagatcaactagggctgccatctggggtcctttctatgaaactacctgggctttctcacagcatggcagagggtttcaagaccatgtattccaggagacaggaagcagaagctgtgagcctcttaaggctagcacttagaaagacagtatcatttctgtgtgtttgcccaaaattaagaaaatgggaaaaagactcccagaatattggtggccttccttaatataccacatgttcagagaaaatactgttattcattgcccactaaatgcacaatttggtcagagaatattgagacatcagttgtggcaagcagcggaacacaaaaggttatgatacggaatgtgtggagatgattttgggaggggcacatttaggcaagttatgaagagctttgaacaccatatcctgagttttgcaattttttacctccagataattgacctgattatttctgtatttagaaagatcaatagagtagcaatgtgaaggatcaactagaggtaggttgcattggaaatagcatgaatgggaaggagttcttgtaacagtttacgagaaacatgatgaacttgggcagcaataagagaaaggggatagaaaacaaagatggattccagtgaaattttagatatagatttagagggacctggttgtgcaaatgaaagtgtagttaagagataagaaagaaccaggtggccctgaagttttcagcttaaaaagtgggaaaaagtatggaacacagaaagaaaatcatgtttgggaaaagaataaaaagatgattggtttgatttaggacacactttatttgagatacatatggaattattaggctacaaattttaataaacaagtggttatatgaataataaattcaaaagaaagttcaagtatgaaacacttaaatttgtagttatcaaattctaagtagtagtcaaaactagaggaataaacaagatcaacaaaagagactattttttaagatgagaagaaactggagatagagcctggggaacaaaaaaatttaagcataatgataacaagactgaaagaaatggagaaggcatagtccaaagtaggaacattgccttattgatcccactaatcacaatgagcaaatgccatatatttgtcacagagaaggttgggctaacaatatattgtttcccaaactactttttatgatccatatgtttattcaaacacgcacaaaatgaggcatacaacttgtaggcgtacaacttgtcttagctttcccaacattgtacacatgcagcagttttacaaaaaggggtattccacggttgaaaatgcagggactttaaaaaagttagtattgttctaaagctgcaacagctttcagaaaggaaatagagtctgatgtttcttcaaataagatctgtgcagtttaaaccttttagaatagccatcttccttaaaaagttcctttattttttagcaatcagaatcactgatatttggctatgaagtcacatctcatctttagacctgacaaagtaagtaaattgctctcagtcaaaaattcagaaaaaatatccttacttaatttaaaagctttgtctaaactgttccataattcttggagcatacattattgggaattaaaatattgactttgaatattaataatgaaggcatcttaaaattccttttagtgttttctttgcctatttcttgtggaatgcaaagagatgattcccatttggttccctgtgagccgcagagtcatagaaataagaatatcagctgtaagttggcaagtaaatctgcatgtaaaccactttcaacagaatctctcaatcctataccactggcagttatccttactaagaataaagctcactttgaattcgagtcagaatctatgccttgctatggggaatgactggaagtgtctggacatcaggtctgttgtcaaaggatggtgcgacatagacgaacttccctgacccaactttaggaagttgtatgacaacaactagaaggctcaccagggacattgctgtgagcacttatttttttttttgagacagagtctcggtctgtcccccaggctgtcacccaggctggagttcagtggcgctgtcttggctcactgtaacctctgcctcctgggttcaagcgattcttctgcctcagcctcccaagtagctggagctacaggcacccaccaccacacccggctaatttttgtatttgtagtagagacagggtttcactatgttggccaggctggtctctaacttctgaccttgtgatctgcctgcctcagcctcccaaagtgctgggattacaggcgtgagccaccgcgcccagctgtgagcacttattaaagggtgagaaaaaggagatatatggaactgctggcttggatgacatgaatagttaaaggaggtgaggaataccaccactatgaaggctgaggctgatattgtcttgagccaacattggagtagtgaagaggatggaagactttaaagtctctatccctttatagttccattccaaaaggtccattatcaattcttaaaataaggacttgctgagttttaaggttttatgttctactgggcacttattaatgtattacttctttttatcttcataattattctgtgatggcacacattgtctttctcattttacctatgagaaaaataaaactctgaggtgaattaaatttttcaagatgaccaaattgagagaagatgtaaactaagtctgattccaaagcttatgttcttttcactatgtgacaatgtctttctaaagttttccatccttatatgcctaattcaaagggataacatttatcaaagtttaatttatataccataaaattcacttattgtaaatgtgcagttcaagaagtttttaaaagtgtatttacagagttgggccactatcaccataatctgtttggggcatttagtgcaagaaaatatttagggttattcgtgatttgcacctgttaagtgattaatgactaattttgattaggtaaatgagaaatagggtaggagatagaaacttcaagtggggcaagcttcagatattttgagatgaatcagatttctttctttcttttttttaaaaaaatttttttttattatactttaagttttagggtacatgtgcacattgtgcaggttagttacatatgtatacatgtgccatgctggtgcgctgcacccactaactcgtcatctagcattaggtgtatctcccaatgctatccctcccccctccccccaccccaccacagtccccagagtgtgatattccccttcctgtgtccatgtgatctcattgttcaattcccacctatgagtgagaatatgcggtgtttggttttttgttcttgcgatagtttactgagaatgatggtttccaacttcatccatgtccctacaaaggacatgaactcatcattttttatggctgcatagtaatagtattccatggtgtatatgtgccacattttcttaatccagtctatcattgttggacatttggcttggttccaagtctttgctattgtgaataatgccgcaataaacatacgtgtgcatgtgtctttatagcagcatgatttatagtcatttgggtatatagccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtccttcgcccactttttgatggggttgtttgcttttttcttgtaaatttgtttgagttcattgtacattctggatattagccctttgtcagatgagtaggttgcgaaaattttctcccatgttgtaggttgcctgttcactctgatggtagttgcttttgctgtgcagaagctctttagtttaattagatcccatttgtcaattttggcttttgttgccattgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagctagttttcccagcaccatttattaaatagggaatcctttccccattgcttgtttttctcaggtttgtcaaagatcagatagttgtaggtatgcggcgttatttctgagggatctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttcgaattctgtgaagaaagtcattggtagcttgatggggatggcattgaatctataaattacctttggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagcggtgagagagggcatccctgtcttgtgccagttttcaaagggaatgcttccaggttttgcccattcagtatgatattggctgtgggtttgtcatagatagctcttattattttgaaatacgtcccatcaatacctaatttattgagagtttttagcatgaagcgttgttggattttgtcaaaggctttttctgcatctattgagataatcatgtggtttttgtctttggctctgtttatatgctggattacatttattgatttgtgtatattgaaccagccttgcatcccagggatgaagccctcttgatcatggtggataagcggtttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagctcctgttattggtctattcagagattcaacttcttcctggtttagtcttgggagagtgtatgtgtcaaggaatgtatccatttcttctagattttctagtttatttgcgtagaggtgtttgtactattctctgatagtagtttgtatttctgtgggatcggtggtgatatcccctttatcattttttattgtgtctatttgattcttctctctttttttctttattagtcttgccagcggtctatcaattttgttgatcctttcaaaaaaccagctcctggattccttgattttttgaagggttttttatgtctctatttccttcagttctgctctgattttagttatttcttgccttgtgctagcttttgaatgtgtttgctcttgcttttctagttcttttaattgtgatgttagggtgtcaattttggatctttcctgctttctcttgtgggcatttagtgctataaatttccctctacacactgctttgaatgtgtcccagagattctggtatgttgtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttgtaataggtgtggtgtggtgctgaaaaaaatgtatattctgttgatttggggtggagagttctgtagatgtcaattaggtccgcttggtgcagagctgagttctattcctgggtatccttgttgattttctttctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggagagttggctcctcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtatgtctctgcatgtgagatgggtttcctgaatacagcacactgatgggtcttgactatttatccaacttgccagtctgtgtcttttaattggagaatttagtccatttacatttaaagttaatattgttatgtgtgaatttgatcctgtcattatgatgttagctggttattttggtcgttagttgatgcagtttcttcctagtctcgattgtctttacattttggcatggttttgcagcggctggtaccggttgttcctttccatgtttagcgcttccttcaggagctcttttagggcaggcctggtggtgacaaaatctctcagcatttgcttgtctgtaaagtgttttatttctccttcacttatgaagcttagtttggctggatatgaaattctgggttgaaaattcttttctttaggaatgttgaatattggcccccactctcttctggcttgtagggtttctgccgagagatctgctgttagtctgatgggcttccctttgagggtaacccgacctttctctctggctgtccttaacattttttccttcatttcaactttggtgaatctgacaattatgtgtcttggagttgctcttctcgaggagtatctttgtggcgttctctgtatttcctgaatctgaacgttggcctgccttgctaggttggggaagttctcctggataatatcctgccgagtgttttccaacttggttccattctccgcatcactttcaggtacaccaatcagacgtgaatttggtcttttcacatagtcccatatttcttggaggctttgctcatttctttttattcttttttctctaaccttcccttctcgcttcatttcattcatttcatcttccatcactgataccctttcttccagttgatcacatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcatcaaaatcattctccatccagctttgttccgttgctggtgaggaactgcgttcctttggaggaggagaggcgctctgcgttttagagtttccagtttttctgttctgttttttccccatctttgtggttttatctacttttggtctttgatgatggtgatgtacagatgggttttcggtgtggatgtcctttctgtttgttatttttccttctaacagacaggaccctcagctgcaggtctgttggaataccctgccgtgtgaggtgtcagtgtgcccctgctggggggtgcctcccagttaggctgctcgggggtcaggggtcagggacccacttgaggaggcagtctgcccgttctcagatctccagctgcctgctgggagaaccactgctctcttcaaagctgtcagacagggacatttaagtctgcagaggttactgctgtctttttgtttgtctgtgccctgcccccagaggtggagcctacagaggcaggcaggcctccttgagctgttgtgggctccaggcagttcgagcttcctggctgctttgtttacctaagcaagcctgggcaatggcgggcgcccctcccccagcctcgctgccgccttgcagtttgatctcagactgctgtgctagcaatcagcgagattccgtgggcataggaccctccaagccaggtgtgggatatagtctcgcggtgcgccgttttttaagccggtctgaaaagcgcaatattcgggtgggagtgacccgattttccaggtgcgtccgtcacccctttctttgactcggaaagggaactccctgaccccttgcgcttcccaggtgaggcaatgcctcgccctgcttcggctcgcgcacggtgtgcgcacccactggcctgcgcccactgtctggcactccctagtgagatgaacccggtacctcagacggaaatgcagaaatcacccgtcttctgcgtcgctctcgctgggagctgtagtccggagctgttcctattcggccatcttggctcctctgacccaaatggaatcagatttctttgagagagagtgacctctcaccttgtctattagtatagacaagaaggttacactaatatgtattatgtaaagccacaatcctctgctttatttcacctaaactttcattgtaccttgaatcatatatttaatcattctttgaaataagttgaaattatttcttatgtgttcctttgcatttccttgaattatttttatgacagcctaaagagctttgtaagacagtaagtattgaagaacatgaatttaacagctagccagaaactcaagaacaataatgttctcattcccacaaggtcattaaactatctgtttaaacacacacatttattttctctgagtcatgcttttctttcttatctgtaaaataatgctgaaatagcttaccacatggaagcactgtatttaatacctaatttcttttgtgttgttctggcgattttctcaacgtaagcagtggattatggtggatgggacttgatactacttatgtgaccttaggacaggtaatcagttttcgaagcctctgttttacataaataaaataaggtccttctgaagcttaagaagataatatagatgaatctcattatttggtacctggcagatggtaagtccttgataaatactcctgaatgaacgattgggtgaatgaatagctgagtgaggaatttctctggtgcaaagaattactgcaaatatctcgctgaacatgccagtgaagtgattctgctgtagggagaagactgatagctgaggggaggaagcaaaatggtgtagatagaattagtttagttggaaaaagaggttggtaagtggaaaagacaggagtagagagacctggtttcacattctggttctctatgaaatgtgagaactcatgcagtttacttaacctcacaactttaaagccttaggtttttgttctgttctgttttcgttgtagagatgacactccttttgtatggtgaagatgaaataagttagcaaataggaagcacgtgccacagaatttagcacattgtaatattcagtaaacatgaattaattttctctcttttgtcccctcccttcattgtgtactaaaacttttgctttgtagacactttgtgactttaaaagagaagtacttgtgactttctgatatgcagagatcataagcgttttgaatttgagggaagtgttgacattatgggtgagcatggggacagtggtagagttgttttgtgaagtcccaaacacattgtgacattgggccagtgacaacctttcacaccattaacgttctcctcctgaaatacaggaaataagaaagccatttcttgtgaggattaaacaaaatgcagcattgaaaataatttcacaaagggcttggaacttagttaagccttcaataaatattaattgctactgctctttccccagttgaattttcatattcacattgaattcccaaagttaaaaatggttgtttcgaaaataaaatgacatcaaaacgcaaatactcaatctgattggaaataaccaccaattaaaatcagtggagcatgagattaaggatcctaaactctttaaatttgggtagagaaagaacttaggagttgaggccaactaattttattttttacattgtactggagacagatgaaagcagccaaccaacacgtatgctttaatttaaatttcacggtcaccaatattcagtattctttcattttgttttattgttcatttattgagtagggtgatttagtacctgaatcaatgggattgcccaatgccatggtacattaaccttatataattttaaatggcaatgtttagagacagcattttctctgaagtcatgttatttgacactgactttatattaagggtatgagagttacttaatgatggaaagtccaaaacagtgatgatcacaaattcatgtttcatgtgaaaggactttgttttagtaaaggggaaaaggggtaagtctctgcaaaatgttagaagttataccctttccccagagtatttcctggttttctaccagcaaatcagccctctgaagtccaagttgtcaggaagcctgtgtctcttgtaaagtgggaagaaaccactccacaattctgctattctctaagcttaatgaaatgctagcaggctgccctgctgttcccgtatcttatatttccaggccttgccacctgtgcaacaaaagcaagcaatctatttagaagagtgtttttcattctcttaactctgaaggtctttattctcagcatgagattattgcaacaacttaacaagccgtgttttctccccctattttcctttcttttctttttgcacctatgtccttttaagtccattcaggccttagggaaacatttagtacttaggctttggtttttcaagctcaatcgggtagaaaatctaacacagaatgtgtgcacaaacgatagctctgcacaatagggacgaacaaatagcacaaaaagaaaggaagaatatgagcgttcagggagcagggctgcacttgaattcaattttccaacagcagacctgatgctttctctcaagattcccaggtttcaaattggtcatatactgtgggccagttacctggacaatggggggaaatggcagtcggtaattatgatcttggtttctaggttgttaggagactaatattaatcctgaaattgtatgaggaatgtgttcatctggccataattgtatagtcttcttgaaagcatttaccagcaatgctaatttaacacaattctccccagggaagtatttttgagctagtggggttgccaatttattggttaacttaggacactttcttcagagcagaaatagcaacaggaaactcacaaaaagatacaggtatgtattttcattttctattaggtgaacaattcagtgtaaagactagcagagcatgtattgttcttcaaaaaacatagtgcctgtgtttgttggcttgcaaatgatagtgaatactactcagttatatgtaattaaaagcatagtgagatactaacaccaggtgataataaagctgttttcagaaaatagattcaatttgaataaatacatcaaaatgttatctttcacagtaaaatatctgtgtgaaagagtatttatcctattctatctccctccaaatcaaagcatagattatagctgtcttttgtttagttttttgttttgtcttgtttgctgtttaaagacaattatgaaccccaagaaattctaaaagtgttatatatttagagacaagataaaatatccttaagcatttgcttaagcttgctttgtaaaatgatttttattgttcacaatgaagattatttcattcttccttttgttcttcttcagtgtgcttatttcatcatgtttgctggacaaagtcatatgtacaattattacatattggtaataaataagagcctcaaaaagtcaagtttctaaattgtggggaaaaatcttagtaggttttatttttgagactgtatttttgagatttatggaaggtaatatgaaagtaggtaataatttcattgattaggaacaactcttaaatatgattggttaacagtataatagtctcacaaattttatagctgttgtgttggaagataaacatataaatattctcaaaaatagtttgctttatctacgtgattgtgatattcagtttgtctataactgatgatgataattgacatcttaataataaacaaacggaatagtggggatagaatattaatatagccaccgaaacaaatgatccaaaatacttgaaaacattatgaaatgcttttaaatcccaatgagctgttttaaatatcaaaatatatatgttagattaaagttgccaacataatttttcatgcagacagctgaaagtttgtatagcaagttgatctgaagagttgggtaaggtttcaaacctgttgtttcttttagggagtaggtgtgcaataaatacttgggaaagtagaattggccccatcttttagatatggtccattcatgataaagctggattctactctgtgtgttggtgttcctagaaaactgcataaggaacggatgtagtcacatgtgttttgtcattaaataattcaacatgctgtttatggccaatactccaaatccaaatgataagaatcagttagatattcatcaagatgaaaataacagcttgagttgacatctgaaataaaataaaaagataccataacaatttggtgtaattatgactgatacccctcagcttacttgaagtgtattttacatgtcagtgtatgttgttatcgtttacttggtcataaatggtaggaatctaagaattatgttgcctacttcccattcccaagccaccattcctagtttgtcatctagttcttgaattttaattcaaaacctacttttcctcttcccactcacactcagttcagtgtcttatctcagtgcaatggccttttaactagcctcctgtctccattctagtaatctcaatcctatagtgaacactgctcctagaataatccttccaaaaatacagaaattatttccttaattttaaatcttgatgtctcccctttgtgtatagaatcaggtataaactccttaatgagtcaccaagatcctgcatcaggaccaagcctgccttccaggatcatgaaccaccttccccctccacaaaccctacacttctgttgtatttctctgaacatattttatgctttcttatctttgagccttagatttgccttttattctttctggattgacttttctctcctttacgcagagaattcacattcatccttcaaagtcttccaaaatatcacttccatataaattatcttccttgattccctcagatagaaaggcaatcaactggtctcatgggttaaatttatatacctatactataagatttagtattattttttagtatttgctacatcatgagaatgagctccttgagagaagaaactgagttttatttatttttatgttccattacctagcttagagcctagcacatattgaatgctcagtaatcatttgttgaatggatggataaattaaaagcaactagaatcattctacactaaataaaattacacgcctgtaatcccagcactttgggaggcccaggtgggcggatcacctgaggtcaggaattcgagaccagcctgaccaacatggtgaaactccatctctactaaaaacacaaaagttagctgggcgcagtggtgggtacctataatcccagctgctccagaggctgaggcaggagaatcactagaacctgggaggcagaggttacagtgagccgagattgttccattgcactccagcctgggtgacagagcgagaatccatccaaaaaataaaataaaaataaaaaaactataaagtaagcagctgatgctacactcctggtcatccacatagcagtttcatgctgtcttctaactacccttggtgctacccaagcctctctttcttaatggagaacttacgagtccaggagtttgattcctcttatttctctcaaacttaattgcagtgaaatgtagttaaaagcttggggatccaactaactgcaatcaaatcctgcccccaggttttacaagctgtgtaactctgtttaagttatttaacatttttgtgccttagtttactcatctgtagtatgtttgattacgtaaccaatatcatacaattgtgattaaaaattaaatgagtcaatgcatatgaagcagccagaattgtgcctggcatgtccttaatacatttcagcaatttttagccattttaattattagttctgggtctcagttacccagggatttgttgatcagtgactagttggttttacaaatgcactcctattgagatcttcatgactgagaatatgatgttttctctttcttcatgatgtttgcatttgaattgttttaatgagacatgccaaagatacagttaatttgtgggaattttgagcactataaaggtttttagatgagcttactgaatgagttttttcccataaaatcacaatttccaactttaagcatttcctgaagattctgtctttgctctagatgaaggtaggtactaagggctaaaagaaagaatagaagaagaaagataagatcctactaaacatagtacaaacaatttttaatctaacaaacaatatgaaaggttatgcaaggttggcctttaaatactgtagaaactcagaaaggtcacatagtttgggatagtcattaaaacctttttggatgaggcatgttaaaagagaactattactaatagatagagttaggatggattgaaaagagacacagataaaagaaaagacacagaatagattgtaggtaattgtctattaaatgtatgagcactgctgctaatagaatctctgagggtacattgcagttcctatgtctcattcaaaagttttaggatgaaataccattgcttatctacctactgccttcacatatcaaatggtagttactgcagtgggactataaagagtggcaaacttcatgcaaagaatattatacagagcatgcattcatgttttgttgttggtggatagagtagttaggagaagagggatggagtttctgtaattttttttcagaggccccttccaactctgaaatgatgattgtctgataataaaggtttacagtactatgctgtgatttctctggacatagattgcatttttgcatactagttcaaaagggtcttcatgtgttctttgttaggacttttaccttcctcatctcctaaggataatctatgagtgcaaaacaactctggaaattagcatttatttctaaagaattacttgagcaactaatgtgagtaggcttttgtatgtctgtagctcctggaagtcctttaatcatcaggaaatgccctacgtatccatcaatattccttgaaaagtttgattttcaagatccattaatgaatgaaaggagcatctaggtcttccatgatttgggcctcatatgtgattctgtttgtagtagacaatttctctcatcgatgtagggaatgtctttgatagtgtaatgacaaaatcacattgcatcatattttttatttcaaatgacattctgatttcctttaaacattcttattagttttggaattagcataaactgatagccttatattaggcatctgaaaaatctattgtagtatgagtattaccagtgagataaagcaggacaaggcatgtggcccactatcacaaagaagcgtgtcacaatctttaacttacaagaaagaatataaagataatgtttctcatttatccatacttaaatattaagtttgagctgtttttatgattacatatatatgacagaaaactatttaaggacactggtttgcaagtcgggcagccctgggtttgagtcctattgtgtccaaaattggtgggttcttggtctcactgacttcaagaatgaagccgcggacccttgcagtgagtgttacagttcttaaagatggtatgtccggagtttgttccttctgatattcggacatgtttggagtttcttccttctgttgggtttgtggtctcgctggcttcaggagtgaagctgcagaccttcatggtgagtattacagctcttaaggcggcacgtctggagttgtttgttcctcccgtccggagtcattcattcctcccagtgggttcgttgtctcgctggcctcaggagtgaagctgcagaccttcacggtgttacagctcataaaggcagtgcacacccaaagtgtgagcagcaacaagatttattgcaaagagcgagagaacaaagcttccacagtgtggaagggcacctaagcaggttgctgctgctggctcaggcagcctgcttttattcccttatctgaccccacccacttcctgctgattggctcattttacagagagctgattggtccattttgacagggtgctgattggtgcgtttacaatccctgagctagacacagagggctgattggtgtatttacaatcctctagcaaaaggtaaaagttctccaagtccccactagattagctagacacagaaaactgattggtgcatttacaatccctgagctagacacagagtgctgattggtgcatttacaatcctttagctagacacaaaagttctccaagtccccactagattagccagacacagagcactgattggtgcatttacaaaccttgagctagacacagggtgctgattggtgcgtttacaaaccttgagctagacacagagtgctgattggtgcatttagctagacataaaagttctctaggtccccaccagattgtctagatacagagtgctgattggtgcatccacgaaccccgagctagacacagaatgctgattggtgcatacacaatcctatggctagatataaaagttctccaagtccccaccccactcaggagtccagctagctttgcctagtagatcccacgccagggcgggggagctgcctgccaatcccatgccacatgcctgcactcctcagcccttgggtggtcgatgggactaggcgccgtggagcaggggactgtggctgtcagggagtcttgggctgcctgggccgcttgggagcccacccggggagcggggaggctcgggcatggctgcagtcccaagccctgccccgcggggaggcggctgaggcccggcgagaattcaagcgtggtgggggtgggctgtcagtgttcgaggacccagcgccccctccgcagctgctggccagggtgctaagaccctcactgcacagggcccgaggcgctggccggcagctgtgagtgtgaggcccgccgagcccacgcccacccggaacttgccctggtccgcaaacgtggtgcgcagccccggttcccgcctgtgcctgtccctccactccttcccacaagcagagggagccggctccagcctcagctagcccagagaggggctccaacagtgtagtggtgggctaaagggctcctcgagcatggccagagcagacgacaagactgaggaggtgctgagagcgagccagggctgctagcccgtggtcacctctcactatttctacttatactgagctgtagtctcccagtttcttcatctgaaaaataggatgaaataagacaatgtgcataaagtgcttagtaagtagaattagtcagtggaggtgaagtgggggtcaatatatagtggcctctgtctacatctttataatttattttgtgatttaagggcaaccatttatgaaataacatactttttcaaaaaaaactggtttattcgtttcatcttcagggtctgtactcaatgaacagagtggaaatgcaattggaaaaactcttaatataaaatcctattaaggactacctgggtgtttccatctggggcttctttaccataccgacaggagagaaattccttcattgttgcatgttccccctttactcctgtgtatcatgtgtccaaaagcttgtggaaatggctttctacttattagaattaagcaactttggaatttaatttctttatgccactattaggaaaatcaaggtaataataatatctacaccacctactgcagcatgagcataagggtaagatgggtttatattcatgacagcaaacagttggaatgtttcctttatgccagtcactgttctgagtgttctacatgtattaacctatctgttctccaaaactcctattaagatggacactacatctcaatggggcaattgcaacatctgttttttctaatttgtcctatattttccaacaataattctccatgtttggccatttataacttaatgatagagctgtaatatggattgaggtagttttgatccgcaaaacactgacgtctcacagattttgacaaccgtttacagtgaataacagagaacttgcatgatcatgcacacttaggctttctacctacaaggaagaggagtctaggtagattggtgatttcacatggaatccaataaaggaaagaaccaataaaaccaaaggctggctttcttttgtaatagggatttgaagaggtctatgaaatgcagtcaaccagagaataagatgcaacgaatgtggaatagaaatccaaattttatatgcagcagaactggaaacatactcatttattcattcattgattctttcactatcgggcattttgttaattattgtcaatagatgaataagacagtacattgcctaaaagtgcaccctgtttactggtgaagacagtattgcttgtcatcctgaagtctgtggcatgaacttgagtgaatcactcaattgcttagctcctctattccctcgcttataaataaggataaaatctcctacattacaaggtttctgtgattatttagagaaggactgcatacaatgcttgaaagaaattgtcgctgaataaagtggttgttatcatgaaggtggtgtgtggaggaagttgaagttacaaaagtaatttacacactcaaaaaaggataagaggaaacaataaaggatatttaacagggatatgtgatatcaggttttcatattagaaagttcatcttggtagcaggatggagactgggcttcaaggggactaaatgaaagatagtgtatctattaggaattattaagtagaggaagaaggctgataaggccaagaggggttgtggacacggaacagaaacaagaaaaatttttaatatagaatacatttttctactttaaccatatcttaaacagggctatttcatgggatttaaaaacagaaccttaggaaaaatcaagaacacaactaagcagttttagtgaacaaatcctatttagaacatttctcttaggtttggggcagccaaaaggtagggattctagatgttaacttcctgcctttgagctcgctccattccccattcctgagagtcagtataggtcactttatttggggccattggacatctttccacaacttatttctagcacatacctcaccttgttacacttttttttcatgtatgtatcccccaataaatggagagttcattgaatgaagattgtctttttctgaatcccaaatatttagatgatgcatggaattcagtaaatgcttgtttcataaataaatgaacaaatgagagcataggagttaatcatgagatccctgaagtaagactgacaggttttgagtcctgattgcaccatcaattactagcagaataacaaacctctaggcctatttcctcatctatgaagtggaaattacaattttaaagagttgcagtgaagttaaatgacacaaatatatgctaagtccttagccttctccctgacacacaatcagcatttattttattaaatgagagctgccactattactatcaatattattatcataaagacactggactcttaatttctgaggaaccattttccttccaccttctactttctgctgcccaatataattctgctttggaaaattgctttgatggaatcaatgattataataactaaacttgatgaacagtaggatggattgatttttattttctttatttttatagcttactctgtcattatctgtctccatgcaatcaatgaatcttagaatatacacattttagttatttagggttaagatggtagataggaggcagggctaacttgccgctcccactcagatggacagagcagcatgtgggcactcacatcctgaacttttgctccaagaaccactgccagaacataccaggaaagctaaaagaatccacagaccctttgaaggaatggatcacttctgcaggctccctgagttgtcaaaaaaaaggtgtctgcttgctttctccacaggggtaccatggtctgaggaaagttcttagccctggtctccagctgcctggaaatagacttgctgctgttgggggaacacagtgggaatgagacaagcctttaggactgccagctatgtgggagcaggttgaggcctgtaactgctggctttcccccagttccctgggaatctgtataactcagcaaaggcagtgataatccccctggaaacataactccattggcctgggaaccatgcccatatcccccacagccacctcagcaatccccacccaaggagagtctgagctcagacatgcctatccctgcccccacctggtggtctttctctatccaccctggtagccaaaaacaaatgtcataatctctctggagctctatgaccctacccatcacctaagaaacctgaatacttaaccaggcatccctaggacaagtttgcatcattcttgtaggaccacagctaatgcattctttttttttcccttttttttgaaacagagtctcgctctgtcacccaggctggagtgcagtggtgcgatctcggctcactgcatggtgcgatctcggctcactgcaagttccacctcccacgttcacaccattctcctgcctcagcctcccaggtagctgggactacaagtgcccaccaccacacctggctaatttttttgtatttttagtagagatggggtttcaccgtgttagccaggatggtctcgatctcctgaccttgtgatccacccactttggcctcccaaagtggtgggattacagatgtgagccactgcacccagctgatgcgctcttgaaagcaccacctcctggctggaggtaaaccaacacacaagcagtgcactaaacaaaaatacaaccaaacaccctcacagagtccacttttctaccctgctaccttcaccagaataggtgctagtattcaggctgaaagacctgaagatggatcacatcacaggactctttgcagacatttcccagtaccagtctggagcccagtaattccactagatggctagacccagaagagcaaaaacaatcactgcagttaggctctcaggaagccccattcctaggggaagagggagaataccacatcaagggagcatcccatggggcaaaataatctgaacagcagccctggaatcccagatcttccctctgacatagtctactcaaatgagaaggaaccagaaaacaattctggtaatatgacaaaacaaggtttcttcacacccccaaaagatcacatcagctcaccagcaatgaatccaaaccaagatgaaatccctgaattgccagaaaaagaattcaaaaggttgattattaagctaattaaaaaggtaccagagaaaggtgaagcccaaattaaaaaaatcaagaacatgatacaggatatgaaaggaaaaattttcagttaaattgatagcattaataaaacacagtcacaacctctggaaatcaaggacacacttagagaaatgcaaactgcatgggaacatctcagcaaaagagttgaacaagcaacagaattgcacaagcaaaagaaagaacttcagagctcaaagacaaggcttttgaattaaccaaatccatcgaagacaaacaataaagatttttaaaaaatgaacaaagcctccaagaagtttgggactatgctaaatgtccaaacctaagaataattggttttccagaggaagaagagacatctaaaagtttggaaaatatgtttgagggaataattgaggaaaacttccctggccttgctagagacctggacatcccaatacaggtagctcaaagaacacctgggaaattcattgcaaaaagatcattgcctaggcacattgtcatcagtttatctaaagtcaagacaaaggaaagaatcttctgagctgtgaggcaaaaacatcaggtaacctatagaagaaaacctatcagattagcagcagatttctcagcagaaacacgacaagctagaagggactggggtcctatttttaccctccttaaacaaaacaattatcaactaagaattttctattcagcaaaactaaacttcataaatgaaggatagatacagtcttttccagacaaacaaatgctgacagaatttgccaccaccaagccagcactacgagaactgctaaaaggagctctaaatcttgaatcaaatcctggaaacacaacaaatagaacctccttaaagcataaatctcacaggacctatataacaataacacaatgaaaaaaaaaacaaggcattcaggcaacaaataatatgatgaatagaatagcacctcacatctcaatactaatattgaatgtaaacggcctaaatcctacacttaaaagatacaaaatggcagaatggataagaattcaccaaccaagtatctgctgtcttcaagagacttgtctaacacgtaagaacccatacaaagttaaggtaaaggggtggaaaaagaaattctgtgcaaatggacaccaaaagtgatcaagagtagttaatcttattagacaaaacaaactttaaagcaaaagcagttaaaaaagacaaagagggacattataatgataaaagagggacattttataatgataaaaggactagttcaacaggaaaatatcacaatcctaaatatatgtgtccccaacactggagcttccaaatttataaaacagttactactagacctaagaaatgatatagatggcaacacagtaatagtggggactttaatactccactggcagcactagacagatcatcaagacagaaagtcaacaaacaaacaatggacttaaactatacactacaagaaatgaactaatcagatatttacagaacattctacccaacaattgcagaatatacattctattcatcagcacatggaacattctccaaggcagatcatataacaggccacaaaacaagtcccaataaattttaaaaattcaaaattgcatcaagtactctctcagaccacagtggaataaaattgaaaatcaactccaaaagaagtcctcaaaacaatgtacatggaaattaaataacctgctcctgaatgatcattgggtcaacaatgaaatcaagatggaaattaaaaaaaattatttgaactgaatgataatagtgacacaacctatcaaagcctctggaatacagcaaaagtgttgctaagaggaaagttcgtagcattaatgtctgaaagagcacaaatagacaatctaaagtcacacctcatggaactgaagcaaaaagtctgaaagagcacaaatagacaatctaaagtcacacctcatggaactggagaagcaagaacaatccaaacccaaacccagcagaagaaaaaaataattaagatcagagtacaactaaatgaaattgaaacaaaaaaatataaaagggaaatgagaaaaaaaagctggtgctttgaaaagataaataaaattgtgagaccattagtgagattaaccaagaaaataagagagaagatccaaataaactcaattggaaacaaaatgggagatattacaactgatacaacagaaatacaaaagataattcaaggctattatgaacaccttcacacacataaactagaaaagctagaggagatggataaattcctggaaatatatatacaactctcccagattaaaccaggaagatattgaatctctgaacagaccaataacaagcagcaagattgaaatggtagtttaaaaactgccaacaacaaaaaaacgtctcggaccagacggattcatagctgaattttattagacattgaaagaagagttggtaccaattttgttgacactattccacaggatagagaaagaaggaatcctccttaaatcattctatgaaaccagtatcaccctaatatccaaaccaaggagggacataacaaaaagagaaaactacagaccaatatccttgatgaatatagatgcaaaaatcctcaacaaaatactagcgaactgaatccaacggcatatcaaaaagataatccaccatgatcaagtgggtttcactctagggatgcagggatggtttaacatacgtaagtcaacacatgtgatacaccacataaaaagaattaaaaacaaaaatcacatgatcatctcaatagatgcagaaaaagcatttaacaaaatcctgcattcctttatgattaaaatcctcagcaaaatcagcgtagaagggaaatagcttaaggtaacagaagccatcaacgacaaatccacagccaacattatactgaatggggaaaagttggaagcattccccctgagaactgtaacaaaacaagggtgcccactttcattcaatatattactggaagtcctggccagagcactcagacaagagaaggacataaagggcatccaaattggtaagaggaagtcaaactgtcgctgtttgctaatgatatgatcgtatagctagaaaaccctaaagacgcattcaaaaagccctagaactggtaaatgaattcagcaaagtttcaagatacaaaattaatgtacacaaatcagtagctatgctatacactaacagtaaccaagctgagaatcaaattaagaactcaacccatttcacaataactgcaaaacaaacaaacaaaaaatgtaggaatatacctaaccaaggatgtgaaagaccgctacaagaaaaactacaaagcactgctgaaaaaatcataaatgacacaaacaaatggaaacatatcccatgctgatggatgtgtagaatcaatatcgtgaaagtgaccacactgccaaaagcaatctacaaattcaatgcaattctcatcaaaataccattatcattcttcacagaactagaaaaaagtatcctaaaattcatatggaacccaaaaagggcccacactgccatgccaagatgaagcaaaaagaagaaatctggagacatcacattacccaacttcaaagtatactacaacgccacagtagccaaaacaacatgatgctagtataaagataggcacatagaccaatgaaatggcatgaagaatgcagaaataaagccaaatacttacattcaactgatcttcaacaaagcaaacaaaaacaaaaagtagggaaaggacaccctattcaataaatggttctggataatttgcaagccacatgtagaagaatgaaactagatccccatctctcaccttatacaaaaatcaactcaagatggatcaaagacttaaatctaaaacctgaaaccataaaaatgttagaagacaacatcagaaaaacctttctagacattgggttaggcaaagactttatgaccaagaacccaaaagcaaatgcaacaaaaacaaagataaatagatgggagttaattaaaagcgtctgcacagcaaaagaaacagtcagcagcattaactgaaaacccacagagtgggagaaaatcttcaaaatctatacatctgacaaaggactaatatccagaatctacaaagaactcaaacaaatcggcaagaaaaaaacaaacaatcccatcaaaaagtgggctaagaacatgaatagacaattctcaaaagaagttatacaaatgacaaacaagcatgtggaaaaacgcataacatcaccaattatcaaatcaaaatcatgatgtgataccaccttactcctgaaataatggccataataaaaaaataatagattttgtcatggatatggggaaaagggaacacttttatactgttggcaggaatgtaaactggtataacctctatggaaaacagtgtggagattctttaaataactaagagttggctgggcttggtggctcacacctataatcccagcactttgggaggccaaagtgggcagatcatgaggtcaggagattgagaccatcctggctaacaaggtgaaatcccgtctctactaaaaatacaaaaaattagccaggcatggtggcgggtacctgtagtcccagctaatcgggaggctgaggcaggagaatggcttgaatctgggaaggtggagtttgcagtgagcagagatcatgccactgcactccagcctagacaacagagcgagactccatctcaaaaacaaacaaacgaaactaaaagtaggtctacgtttaattcagcaatctcactcctgagtatctacccagaggaaaagaagtcattatacaaaaaagatatttgcacatgtatgtttatagcagtaaaatttgcaattgcaaaaatacagaaccagcccaaatgcccatcaatcaatgactggataaagaaaatgtggtatatatatatatgtatatacaccatggaacactactcagccataaaatggaatgaaataatggcatttgcagcaacctggatggaattaaagactattattctaagtgaagtaactcatgaatggaaaaccaaacattgtatgttctcgctcataagtgggggctaagctatgaggatgcaaaggcaaaagaatgacagattttgtatatatatatataataattatatatatttatatttataatatatatttataaataattatgtatcatatataggatatatatataaaatctatcctatatatcatatatccatgtatatttcctcgccatagggaaacattaaaaaagatcagctcattgggtatccagaaatagaaacagcttgatcttcatgaggtagtagggcaagagctgtctttaaagaattagaccaatatgagcaggagtccctgggacaattgggaagttgttttcacagctttgtttacttaccaactgaccaaacatgaaagataaaacccaatatgtgccaagggctcccctttttacactctctttggcatattccacatttctaaattattcatttgagaagcacactttgcactttttattaaacacatgatcgggctggatttctctgtagtaggagacttaatttgccagtgaactatggcttcaggttggccatctggaaaaataaactcctcaacagccatgtaatttgtcttttgtctggtttcaggcagtggatttttggggatttgtattgagcaaacagcaagcaggcgctttcctgcctccttgaagccctctttccttctcttagggtatcttgctaagttacaagttaacaaatggttcttactcctgtaatgtctttgtcaacactttgtatacatgaacctaattttcaataaaacaaaacagctttccttttctactcagggaggcaatgccatatggaccaaagcctgaggtcagaaaaagcatattgcctggaaggcaggcggatgcaccagctgtgctttttgcaccagagggtgagggggtggaaggaggagacctttctggctcagctcataatgctttcctcccccacctcctcaacccaccaagttactagcctggttgtttgggaaatgtcacaggagacaattctcatgttttcctaaatctaattgtaagttttccccaaagtctaaataccaggtcgtctttgttacatctcagcatgtaagaaatacagcttgacaagccaacatcaaaaccccatgtgctcagataaacaccacagttcctgataatttgcatttgttacaggtccaagtatagctgtggaatcattctgccctttctttgataagaaaacaactagagggccattctagttgtggtttaaaacatgggtgaaggggtcaaatagatctggattcctggcctgattcttctacttattagctaagttgtctcggctgaattaccttaccgtaagcctcaatgttttacatttgtataatgaagataatattgctaataatcatgcattcatttctaaaggcttatgataattacatgaaattatgtaggcatgtaaaagtgctaacataagtccgttagcattggcaaaagtactcaattaattttaattttaaaaataaaattaagtaggccaaatttacatttgttaggtttataccacatactaccatactctgtgctaggtttttaatctgataattatacttacttcttaaagttgtattctgtgccaggaactaggccaaggacttcatagctactaattctatgatataagaattattgaaattcagagaggttaactattattcccaaattcacttgtggagctaggattaaacctgggtgttcagactttgtttttaccaaatcggtaaactcctgactacatgaaaaaatataaaactgcactcaattgcattagtatttcaacagtgacagtgatttcaaactatttcttacagtcttcatagaacagtagccacagataatttagccaatgccattcccttttttcacttaatatgtgtgctgagcatctttatccatgtctagtgccaaagaaaccagtttccttcagctattccaccaaagaggtttgctgtcaaagtcaaaagctgttctattctacaattctgtattcattttctaagactgttgtaacaaagaaccacaaagtagtggcttaacagaaatttgttgctttagagttccaggctagaaatctgaaatcaaagtgttggcagggttggctctttctaagggcttcaagggaaggatgtgttccacaccagtctctttgtcttgtggatgtccatctactctgggtgtctccacattgttttccattttgcatatccctgtgtccaaatgttctgtttttataagaacactagtcatattggatatggaacacactctaattatcatactttaacctgattacctctgtaaaaatgctatcctccaaataaagttacatcctaacctactggaggttagcacttcatatgaatttgttggggacacaattcaatttataacagacttattagtgggaatatgccttgtttgttggcaagtttaatgtatgagttgaactagactgaagaacacagtaagtctcaatatttaacctaaagaccatttctttattgctttcactctcttactttgtcatcttccatcccaccaaacccaccaaactttagttctttctatgcaaattatctttgcttggcactttccatttcctcttctaactccttagagaaggctcttgttatgctgtagtggacagtgttgcttgcttaccctaaagctgttcttcccaaaaggtcttccttgttttgacaacttgcctccaaaatgccagatgaaggcttctgtttatttcacagtcttttttttaatatccagaaatgagatttctccatgttagaactgttgacattttgggccagataattctttgttgtggagagctgccctgtgcattttagtatgttttagcagcatccttagcctctatgcacctacatgccagtagcactcctttagttgtgaaaaaagtatctccagacatgataagtgttcctgggggtggggatggcagaatcactgctgtttgagagccgatgagctatagagctagagtatggccacatgacatggtctaggagactggaagggatgttaactgaaaactttctggaaaaagcacacatctttactgaaaagaaccttatgagaggtaagttctcgttttattttttctagaagagattgtgtctgcctagaactaccacagccattttgccatcctgaggggagagaccgccatcataccaaggacggcagactgggaaaatagaaatatttgtgtccttgactgcattgtcaagcaactgaactaacccagtaactgtcctgtatctagacttcttcttatggaggtgataaatgctgttattaagccaaatttaatttgaatattctcgttgcagccaagagtgttctaaatgacatatatcctaagagggtggatgcaacaggttgctttttaaatttgtctacatgtttaagttaagactgtatttttagccatttctacacaaagatttagcaagacgtactatttgtatgtattttccagaattggtgatggatttctgcttacctatccaaaatggcttgctttaccctttaaacaagagcaaacatggtcttgatggtgagcctcaggaggattacagtctgcctgatgcactcagcgaagtttaactgccataaatagagacaaaaccctggaacttagtattattgtgtgatatattaatcagaggaggtattccaactgtagacagatcaaactactaaaatgtggctttagctcattatcttcattttgtaacatctctgcagcattcaacactgttatcatttcctccctcagaatctcatccctgaatttcatgatcttgtattattttgggtgttttcttatatttgtcatcattcttttctgcctcctttgttgtctttccttcatcctttggaataaagggatttaggagaaagatgatgtgttttggagtcagccatatattatatattattgtttaataacctataaaataacctatattattatgttaaggtgcatataatggtctcaattttgctccaatctgtaaaatgggaaaattatatcagcctacacgtgttttgtgtggaaagaaagggttaacatgtagtagattgttggcactcaagaaatattttcctttccaacgttttcataactttggatagttcccaactctgtattttcagccttcattttcaataaatgttgctcaataaaaattaatagcatcttaaagcttcaacttcatgttagtatgggtctcaaagacgtcctgtcactctctctttgacgtcttctcaatgacctacaagacatctctattagattgtctaatcatctatgttaaaataaacattgctaaacaaactcacaattttacttactcaggaacactttcttttctaattctataatttaaaaaaaacagaattacttgcacagccacataaacttgtgaaacgtaagtacatatagcaccttaagcaatgccactctggtgaacctgagtccgtattttaccatttattgtggctgagtcagctctctgagcccatttttacatatataagtgtagttatgaggcagagaaataatatatgtcaagtgaatggcacacctcctagggctttaataaatgccaagtagcactgctttattgttaacaataaggttaacagttttatatagaatagttttatttatcatctaaaagctgatataattaagggatgtaaaaaacatcaaggcagggaggtaaacggagaaagaataagaaacattaatattaagtatatgtgaaagaatatgtgctagttattcattatgtacttatcgtgtgccaggaacaatctaaaccttcaagtgtagtatattgaagcctgtgtgagctactgaagcagtaccaaagtggaagaacacactgagctgtgacacttagtaattatgcaacctcagatatatcacttagcctttataagtcttagcacattcttcagaaaaattggataatatcacttacctcactttgtatgttcatgatgaaatcacaaaaaggacaaagtgttttgcatgagcaacagagactcatttttagctaaatgatatccgggctgggattcagagatttccccaaactgtgttgtgacagaaagcccaaacgcttgctaatgcccatctcatcaataagatggtcatcattgcatatattagggccatccatgttagcccggacgggagactcttaaaataccaatggaatagtagaaaacactcttcacaaaatgtttaacactaggtctaggggtttggggtagtatatgtacattcaagataattcacaaattttcttggaaaatcttaagtcccctaaaagctgactcttcttcttaaaaaagtgagcatggttcagctggagcgctaccccacacaccccctacctttgttatcactcactgacagtactaatttgggtgatggaaagcctgatatttcctgctgtagcactcgtgtagaattttgatgtcatttgatacttccagtataataagctccacttaaatgggaggactcctgtcctatgaattttatgtcaactcttctatattagtccagaaattagaatgattggagaactacttgtccagtttgaagttggatgttgtctaggaagtgaggccaccatctggagctgagagtttcagcctaactactgattctccacaaacaatatctacggacatgtacagggcctcaagaaatttttaaatccagaaggtattatggaccactcccatgcagtgctaggaagaagaaccttagaagaccatatcttttgtttgaacaaacaagagaatgacatggtgtttttgctgacacagcccacatgcatttggaatgaatctttagaggatttgccaggagaaaaactttatcctgaggtgcaaaaaagagtttctggagggagtgagatttgtttgaacctgtatactgattgatttctcaaatggcattgaaggtggaggcgttggtggacagcagggagtgggcgaataaaaagactgcctttcttgtgcatgcgaaagcctgtcacttaggggcatgtgcctaattatttctgtttcacgcatgggtgccctgtttgctaaaggtgttgtgaaaagttgccaagagataaattcaactgtttatgagaatcattatgaggttcagtgtttatttccctggcaccctccaagatctataacttcgagctgaacagctgttttctggtgcttgtaaataggactatttaaatgtcttaaacacattgtttaaaaaaagtacacaaaacaggatgcctttctagcattgggaaaactgtaagaagaaggaaaggaaactttatcatttggctattgctaacatttattgtgtgactgggatagtgttacattccctcagtgctggttataaagattataattaagtgggcggtctctgtagaccaactcagaagtgcttctccttctcaggttttagctagtgccttacttaaataggagctggaaaagcaaaataagatctttgaagccacacaatgtctggtctgttttggctaactgcattgtaatataactgacattatagcaggtagcaggataattcatgtcagaaacagtacaattccatgttttatttataacaaggaacaaaatgtgcattgccgtaattctgtgcaaccacttcctcactgactaaagaaagcgatgacttggtcaattgttgacctgaaagtagtatcaaaatggctattgtgcagcaccagtttatcaaagtaatattttaaaacctgagcctttaaattcgaaaggacaagctcagaagttcctcttttcctttactaagctcctagcaatctgtctcatggcttctaaaatgacatccagcttggttctccaacatgtgtgcaaatggaagccaaagcttagtaatcgtcagggtaggggtagggaaattatggctcacctactaagcatgtatctgtgtttagttgagaagccattgatctcccattttctttggagaggagtatttctgtgcctctctgatcggttgggaaggtaaggaaagaaaagaaaaaagactggttgagcatggtggctcacgcctgtaatctcagcgctttgggaggccgagctgggcaagtcacttgacgtcaggagtttgagaccaaactgggcaaaatggtgaaagttcttctctatgaaaaaagtacaaacaattagctgggcatggtggcatgtgcctatggtcccagctacttgggaggctgaagaaggaggatcacatgagcttgggaggtcaaggctgcagtgagccatgatcacaccactgcactccagcctgggtgatagagcaaggccatgtttcagaaaaagaaagaatgaaaacagaagtcaggattgccacattctttagtataagaaaatggattgttagaacttccctgtggatttgggactaaaagtttacagactcaattacctcgctaaaaaacttgcttaaactcctgaggtttgccgcagtgccctttccttatgagatggagagtttcagctttgactcatttagctggggtataaccaactctatgtggctgtcactcttgaagattcttgatacgtcctgagggcatcagattaccgtgtgtccagactgttttgcaggacccgaaggaaaattttcttaatgaaggtaaccattttggaggcctctgcagccagacctgtttcaaaccaatgtccaagactgcaaaatgccaaatgtcagactgacgttgcattgtgctaagacctagctaaactctttgattcaaaaggatgagtttaaaagaaagaaagaaaccaagggaaactgccatttcctcaaatctaattgaaggttgagagggatcaagggaaatttcaataggttggaagctagcccccaggaaaaccaatgaaaagggcttggaagaaagaaaggaagccttgctgattagcttcccctgtggagaacgtctctgccacttggcttcctttgatgagattacagacttctgaaactggttcccaccaggaaggtagacatgttgaaagaacatccttctaagtaggcagggaacacattctttgtccttgggaaagtacactattttgctctctggaatgacttgatcatggtttcagccctgagaccagagctatgctgcaggagattctgagccaatctagtctaagatgaagtttaggtttatctggggaagttgtaataatttcagatagtcaaaattattgcattcttatcttcataaaattcttcaacatgataaagagactttaatgattttcttacattgtttgttcttgagattgctccaattgtattttgccatggttctcccctcctcacttgcccacccttaattgggtgaaagatccaagctcactttatattgatttggataccataacctaagtaataatttctgccacctctttttttcatatgccctcaactctaacagcattcatgtataccaattcatgctttcatgattgaagatacttagagttgaagactttagtagtcaactttccaacctaaggagaaagctccattcctgactgacaatcatttaaatcttacttaaaaccctcatcatcaggggacattcttgggtgaccttaaaccttttttggtacattctgtcttttattcaccatcctctacttatgccctgtcctcatttctccacttatcccaaccttaaacattgtccaagatccagtttaaattctaccattttcttaaactaaaggcaatcatgtaagcctataaattcagacagttacacaatcttaatcagttaaaaccagaagtaaatgtagagatcttttagtatagtctcctcattttatagatgtgggaactgaagataaaggagatctcagataagaaagcaggttataccctacattttgacatcctctctaatgcagtcttgaacaatatatttgtttaatactgcaaatatgtctgattatcacagttgtaagctctggaaggcaaggattgtgatttctgtgtctgtattttgcatggtggcttatatatacaaggttgttctaactaagttctgcccattagaactttctatggtggagtaaattttttacattctgagctgtctaggatgttaatcactagccaaatacagctgttgagcatttgaaatgtggttagtgtaactgaggagttggatttttaaagttgtttcattttatttcccttatcttaactaccgttaaattatttaaatttaaatagccatatattgctagtgattagtatattgaatggtgcagctctcactcatttcgtgattcacatcaaattgataaaaatttgagtacatttgttgatttttaaaatattttttgacttagtataatagaagtctacagatgaaaggggcaaagtctcatcaccttaattaataatgagagcactggttcaaggtcacatggttaattagggacaaaactggcaccagggcacaggcctggctatagttaagttatatttttgtttgtcataatgcttcagggaaagtgggaggatgaatcaggtagtaagtggaaaggaaaaccaagcaaaaaccatatatacatacttttatgtacatacacacatatgtatattctcatttctacagttctcattcattctctctgtctctccatatatatatatatatgagaattgtagaaattgtacagaaggaagaagaaaagaaacatggaatcatcctaaatgcctatcagtggtagactggataaagaaaatgtggtacctatacaacatagaatactatgcaaccataaaaaagatgagataatgtccttcgcagctgggggacattatcctaagcaaacaaactgagaaacagaaaaccaaatactacacgttctcacttataagttaaagctaaactatgagaatgtatggacacaaagaagaaaacaacagacaccagggcctacttgagggttgagggtgagaggagggtgagaatcaggaaaaaatctgtcaggtattatggttattacctgggttatgaaataatctgtataccaaacccctctgatatccagtttacctaaatccctgcacatgtacttctgaaactaaaatataataataaacatgcacatgtaaccctgaaactaaaataaataaacctgcacatgtacccctgaaactaaaagaaaagttaaaaaaactttaaaaagagaaagaaatccatgcaaaaatagagaaatttgtcaataccagagaatgaagatgaagaaaggaaaaaaaaaaaaaaaacaaacttctgctttcatccatgagcctgtgtgtaaatgaagaattcccttttagagacaaaacaatttactgtaataaatcagggactattgcataggtgcagtcaggattacacaatgaagagagctttgtaggtactgaaccatgacaaagtcttcatactaatgaattacattcctcaaaaacctttgtcaaatcagtcaaagaactctctccgaatgagcatggaatgttaacatctggttcaccaaatagagataacagtttcatccagcccaaagccttagttagtcaagcctttatccctccctgttgtctgctgatcccactttatccttccttttgctttgcagctgctcagtgaaggagagacttcgttgaagagtattgaatttggtgatgtgtaagagacctgggaagtagagtgccaatggaagtgaatggtttggaagactaaaaagggctctagatgctccttttctatacagcgtcctgataatcttaacagattcaacaacctcccaagagaaataattcctgtagagtctatagcatatcattaaataagagaaacaactagttttcaaaagttcaatggtgttcaaaacaggatgctgctttgtttgtttgtttcatagtattttgtatttcatagaaagaaggaaaaactaaactaaaatctgtaatatcattattgataatacacatattgtctctttgtatatttttccaagttgtctagtaagtaaaatgacactgggattttcccaaagtgtgtggatatttattttcttactaatttaatggatttttcagttaaatcataggcacagcaagcttttcttttccatattaaatgctactttatctgttgacatggcaccattctcaaagtcataggcacaggtgaggatttattcatttaggattgtaaggtgaggggccaattatcagtcccttccaaatctcatcatctctgtcttcctcctactcaccttcttcttctgggatcccctatttcgtatgaatactaccacccatgctgacaacggttttctatgtctgtgaggtattctggctgtgtcctaccattagatgattgcttcatcaggcaggttctctttccacagtgtctcctatgtccctctcctttctctttcactgctaccctcaaccagactgttgttagttttctctttcctgttaccggcacaagtcttaattctggagatcaggactaattgtattattctatagctcacaaactttccatggtgtgaggtaactataaggaaggaaaggagaaaaaggacaggaaaagaaggtaaagaaagaaggagaagagtaggaggagaaggaagagctggaatggaagagaatagaaggctaagaaattttgctatatacaagaattgaacataaagtattgacggcaattcaaatcaacgcataaattatatttcatgtaatagttgtgaatacaatgctggaaaatatttaagttgaatttttactttccaacaaataccaaaataactttcagattaattcaaatgttaaatgtaaaaaagttcttaaaaatacttgagaaatgtctgaaataattatgtaatatcaaaatgaaaaaggtttaagtgaaaataataaaggaaaggaataaaggataatgtaaaagattaaacataacataaatattaaaaataaaatacaaaacctgtgatcaaaattcaaaagcaaagagccatctaggaaaaaatatttccaaggtaaatggtatacaaagtgagagtgtcgttaaaatataaaaatctcttacaaatcagcagagaaaggagcagcccaatagaaaacttgacacagattatggaaagggaattcgtaaagaatgacccataacatgaaaagaaagtcacagatctattgcgtttttttctctatgtgttcttcactgttttctgcttgtaaaatagatcctcctttcaaggttacatttttttctagtttatattttgttttgcctttaatattctaattcacttagcatttatttaaatgtatgcttcactgaggcaggagaatggcgtgaacccaggaggtggagcttgcagtgagctgagatggtgccactgcactccagtctgggcaactgagcgagactctgtctcaaataaataaataaataaataaataaatgtatgcttcaatattagagtccattcaatggtagtctttttcctccttcctagattgtaaactcctgagggcaggaacaatgtgctccttgttttcttagactctgcagcatgtagcaagtgtgtaagatacaatcctcaggttaagagaggtaaagagagataatcagagaagttttgagaggagttatcttttgagtttaacctggtaagtctaaagtatttgcaagattctctttttcttttttttcctttgtttttatctcttttggcttgaacatggcttagaggcaaagtaacatgacgtaggagaagaattctgaagacaaatgaagatttacatcctgacaatatcaatcacttatgtcgctctaagtctgtattcctcatctataaaatagatatgagtacttacgaggttgctggtaagataaaaatccatgcttgtaaagtgatcagcatattgattccatttccttattactacttaattctgctcttgttgagggatacttcgcacccttggccccttctttagtgaagtagaaatgtggcaatatctgtgaaaatgtcttgcagttgggatgctttttaatatcataaagtactattaatttaaattttggatatttgtttaagtgtaaattactttcagttttccttaatgacaaattgaatggaaataatgtttgagtgtaatgattcagcataagtccatagaggtaagaaaacagagaaaagttaatatggcacatagctgatatttgaaaaatacttcctttttgattcttttctttcatcttagaatagaccatcagcctgattcataataataccttttgatatttagatatttgacatgaatatgatttcctaagcgcccaaccaactaccagtgagtgacttagactccagggagaatagatcccactttaaaaaatgcattcaacttgatcttcatgtttaccaaaggatttttggattcatgcatgtcttatggcacatggtttaaatctccatgcatattcagttaatcatctcagtttgtcttacaggcacatagccaccattttgccacggtgaagactgaaaacattgtgtgctaatttctttgttttaggggaggttatcatagttgttatcaggcctgctttgtaaattttgtgagctgtaaaatgaagtactgtatattcctgggaagttttttcccactgagaatatttaagttaaatgtttttttaattgtctgggagggcagatgctggcaataaaagaaacaatttgaaattttaaaaataagcagcacatttatagcaactatatgggaatattattagtgattaaatatagtagtacagaataatatatctagggtaaaaaaatactaataattgtaacccagcaatttttttagttctttttgttttctaataaaaaatgctgtattttaggatgaataaggcactatatatcacatttgcgtcagtctgtttagtgcatagtggagtgcttacattgctaatttgtcactaaaattgttagttaaggaatctgattccagtctcttttatattctctttagatgtggccttgaatgaaaagaggcaataccccttttcttcaataataaaacattctccacaaattattttctcttctttcctaggctgtggagataggggttttctatttcctttacctatatgttctggtcataactttatctgtctaggaagaatttagtgattagctgaactttcttaacctctgattttgttttctgtttagggaaaaaatataatgtttgtgagtcaactatgtccatttatgtactttatagaaatctcatttaattacttaaatggtatgggtttgattgtcgtcattttagggcttagaaaaaaggaggctcagaaagttttgataaatttttctatattcttattttatgagtgagttgaaattataacctgggtctgcctagctataaacattaattctttccaatctggtaggatattggagttttacattgatttgctagagttcttacatgactatttttatgattaaaagattatgtaaggataatgattcattcttcttttatatcccaaaatacggactagaggtggaagagcaggcttttgatgggagagatgaagagcttggtttttaacaagcttttcaagtgtctgtcatacaaccaggtgaaatcgaatatctggaacctaattgccagaaagagtgactaggactggagatagaagtttgggaacacgtaacaatagttgcaaattttggccttctttggcctgttttccccattctcagagtgattgttggggttatggaactaagaaaggacaaatttgacatgtgggaggttcttctctaaagaagactgatgtagctacgacatagaagatgccatgccattaggagatgtgggtagaagtcagcctgtgttcctcaagattatctaaaccagaaattctcaagctttggtgtgtgtcagaatcacctggagagttaatagagaatagaggcccagtagggtaaaatctggacctctgtgggtttttttgtttttttttaaccaagctctggaaaaaattctgacagatcctcaaatttgagaaacactaggctaaaccatattttatttgagaaacactaggctaaaccatattttaaccatatcactacatagctaagtagtaactatagtaataattatatgtccttttatataacttgggagaatctgttgctaattcaaaactcgaattaaaatttcttttatgttttttatgattacttaggctgacaaatacatgcacacaatgaaatctttctaaaatgattctaccttgaatcttctagagagggtgaggatgagcacgtccaggacatctaagaaattctccttctcaaacttggcttttcctgtgggaaacagagtgaggaaaagaaaatgagtcccaatcctccctggaggcaatgcttacacatattttggaatcagaggatctgcggccaatttcacctgtgggcagggagaacacacctgttagctacatgttttttgaaacaggctgtacttggccagattacaaaaaacactgttgttatgccatcaaaaaaagaagctgacttacatgtgaataatacttattaaaggggattttaagaagctggacacttgagaaaagcaagcaactgtgaaaagaatacctgcttacctttgtacaagccaacaattacccccccaaattgggttaggattagataaggcaatcagttgtaatagagttgatatctgcgaaggggaagtttgagtcattcagagataaacctcttattatggtttcttttccttgatcatctttatccttctaccccacgcctacctttatgcatagtggtcattggtggggtgaggaaggaatgactttggaagtgctccttaaccaggcttttgtgtgcattgtccgaggctcacagctttcttatcagcaggctttcctgccctgtcattaggcctggtggcaaaagaggctctttctcatgaactgacccatgctgcgagcaggtcacctcagatggaggcttgctgctttattcagaggcttctgagattcccagatgttgtggcaagatgcaaatatggagaaaggctttcactgctcctccgttcaaaatgggattctatttggtgaccgaatgcagtttcataggggcatggttgagtcttaccttccacaattggaattgtaaaaagagtctctttgtgagagcaatagttaattctctgtgaatgttactacagtttagggagaataagtatttttccctctcctttatatttccccttcacttatgcttaaaaacaggtaattggagcagggcttcaaagtgtaatcttgcccaaaggctaagcttgccacctaatgacacacggttgttctttattgaggcagtcttgcactcattatctctaaattagttcccctttctcctttggtttattattcatccacctcctcctttttcatttggatttttccaagtgaaccatgacaaagtgtgtctttgtgaggtgtgtgtctgtgcaacagtgcatctgtgtgagtgagtgtgctccctacccgtgcccctcctttacattaagtgtttatttaagccaaggctctggaaaattgacaaaaatatttggcattgattgcctcataatgatcccacatcaatccaaggaggaatctagctgaaaagtagaaggagctgagatttagttgcaggctttcccttgtcaaggccagatgtaagcagctcaaactcagagaaaagatgggaaactagtttttgagtgaaaactgtgagagtgttcatgtaaaattataattaaaactttagcatcctgttctaccaaaagttttatgtaccactcatgtgatattatatccagttggacttaaaaaatgaggtaaaaagaaaatactgaagtagctttctttgttcagatctgggttagaatccctactttaaccctggtaacctactattgcttagcccttctgagctttggtttcttcatcttaaatagaaataatatcaaccttacaggtttgtggtaaggatgaaaagacatattaaaagtgcttaatgcagtgcccattacaatttagataaattatattttaaaatggccacagttcttaattcccttataataaactaaatcaaagcttggaaggttttgacttcatagctcgaaaatatgagttcagatctcttctctctctgggaccatttctttctttagcttgaaaggggacctggcattttcgctacatacctagccctctgctgggcggagtttatatttgtacacactctgcaaaggcataatattattcccatcttgaagatgagaaaatggaggctcagagaggttaagtaagttgctcaaggtttcaaaggaagtgatgaagcaggtatacaaataacggtttgtcaagtctcaaaagcgtataatacaactgagaattatggtatatcttattcacctaagtctgctttgagatagttatatcctcagaaattgtgcaacaaaatcttctgattcagaaggttagtagacttattagtacaagagaagagttaccaactttgcctgactgattaattcctagggtgaatatgtgatgtatatattaaatataccagacttagtcttgatattattggatagattcaagtacttcctctttaccacgatgattttctctagacacctctatcacagtgtaatcttttttaatacttgtgcaaactcagcaatggctaatggttatttctgtgatgcagatgagatctacctctcatataccacattttattttctcttctttatcctatctttgcattccaaaggtaatcatttattcttgccttcaccatattccagctcaaatctcctttctcttcattcacccatgggtgccttggtgttcttctgcctctgtaggactgatagccctgtgttgctggttatgctctattactttttgacattatcctcttccttatccttcaaaagcacttcttcctcctctaccttttatctttcttccatgaaaccagagttagctgggagagaatacaatagagtatctgggtataggggtatacataaaggttctacttctagctgggtggccttggtaagtaatttaacatctccatgcctcattttcctcatcaataaaaaaaaaaatccacttgtaactttcaatgattatttctttaccatagctcaaaaggccatagatgctgtttttgtgccatgacccccattggaagtacagtctcttattcaaggagagagttggtagcaataataatatgtatatatggcattttctattcataagattagtgtgcagacatcattatcacttgttccttcgaacaccgtgacttgggccaggtcacctagctagtcagtagcagggccaggacctgaatatgatcctccccatttctccattctgaatcttgcattctttgctctacacctcagtagagtaaggtaaactggctgaggcatggagagagaaagatcaaaaagttttttgtattgtgtctctatgtgaactgtgctgggggaatgaattggtagtttgggactgagagtagaaaatttaacaatagaaatgatagtattaatttttcaaaaagagaaaaaaatttccaaattaattattgtttcaggccttaccgttttccctaaacatctgtaggacaacatcagagaaagacagtgtgctgggagtgaaacagaaaacttaatttcaacttgaaatttctaaattttactgttaaagaacttaacactaaaaaatgcagtgcaagcaaccacagcagcttagggaattttctatgttttctgaatggtatttcccctaaaatgaaaacattccttatttaaaaatccattctagggtttgttcaaagattaacttatatagtcccttgagatacagggctagggacttactattttttttttcatgtcaagattaataacttcttctcagattgaccctgtcctgcccatgtgagataactcaagtttaaatctgtctattgtgtgctcggtagcttcttttggccataaaagagtttgttctccattaaaagaacagttacatattccaggttgtttgtgaaagaataaaatatatctgtctttgttcaagagtgatttgttagttgtgagtgtgaaaggggaaccgggaagtgttgggtggtttcaccacatattacagaagtctagtgtaacgcatttggctgagccctttctcatttaaggcttaaaccaatatttatttttgaaaggaaattcaacccatatgtatctgcctcagtggacttgttggctcttcttgctaggaatcaggaaattacttttgctaacattacaaaaggcctaaagagcaagtgaattttaatcttggcaaatgtagcttccactctgaaaggaggaacataggttccaggtaacaacaaaagaaagacaaacattactggtgacttccaagataagaagggcagagaagactgtgcacattctaagaattactgattgtttcagtttgtcccaaagccaatgtaatttgttctttaatgcagattctcacatgtgtagttgatagtacaaattgttcaagcaagtccagctatacatgctaaaatcttagtgtaaaaagaaaaataataatataacatatttgattttgtgcctttcaaagtaaaaattatgaatgcatgctgtttatcttgagcaggctcgctgtttatcttgagcaggctcactgttttggtgtatatttttcatacaaaataggaaagttggccaggcgagttggctcatgcctgtaatcccagcattttggaaggccaaggcaggcagatcacttgaggaccagagttcgagaccggcccagccaaaatggtgaaaccccgtctctactaaaaatacaaaaaaattagccaggtgtggtgacaggagcctgtaatcccagctacttgggaggctgaggaaggagaatcgcttgaacctgggaggcagaggttgcagtgagtggagattgcaccactgtactccagcctgggtgacagagcaagactgtgtctcaaaaaaaaaaaaaagaaagaaaaaaaaaagaaaagaaaaaagaaaattttggggaacaaaagactatatttttatattatcttgaaatacaaaactaccttacactatcttctaaattgattaattcaagaaaaatatgtcttcacagagcatatgcactgctatttctaatttactataaatatttgatgcttggaactattctaattttctgtctttagctaatttagccaaagatttatctgtggaaaactgctctctttagattgactgtccttggcctaaatacaggttcccaggagtggtgggaatattgaaaaccaagctattcagacccagagctgggttgataacttggtgcagagagataggtacaaaatgtggtgactttctggaggtgacttatgacagttaaaggaggagtcctggacaagatgaagttaggatgcaagttgtttagtatcatgagaacttgagcatagagtaagtaggtcttctttctggttggagcttagacatggtccgaaagcccactttcccttgtaagaagtctgcaggatggtttcctccttccaggtcctagaagcatccaagcaaaagtcacattgtaataactctttatttggccacagatacttccctaagtagtggttctcaaagtgtggtttcccagccagcaccatcagcattacctaaagggttgttaaaaatgcacattttcagatttcatccaagaaataatcataaactctgggagtggggatcaacaacccatgttttaacaagccatccaagtaattccagtgcgtgctggaatttgacaatcattggtctaaagcagttgacattttcagaccttcggtgcaaaactctgcaatactatactatagttcttgaatttgtgcacatttctatgattttaggcacatgttctatgtggacaattagctattaactgcatgttttaaagggataatggtttattttgtcccgggtgtttcaatttctatctccctggtcagtgtggtcagcacaactttcaaacagtggttatcatctgtgatttggctgcttggatcttgcctaataacactccccagaagagtcaagctagatttaggtggcccagtatggaaagggtgcctgacagtctctttctaggaagttctgaagcaataggtcatgtatttgtgctgctgctccagtggtacctttttggacctcagtggaaattctgattctgccttgggcgtgataagaaagaatccagatttctagaagctcaaagctcttgggataaagctctgacccttctccactgcaagattatatagtaatctttctgaaatattttttaaactttaaatttcccttttagtaaaatttcaccgaaattttatttgtttctgcttaatagaaagtggcttcaaaccttcttgtacatgttctgtgaatccatatatttatacaaaagccactcatctaaaaagacacaaaactattcttgctcctactctggcatcagaaagtgagtcctaactttgacccctgatggacacatattcttcagaggtcatactccaggcaaatgattttttttttttttttttttttgagatggagtctcgcactgtcacccaggctggagtgtagtggcgcgatctcggctcactgcaagctccgcctcccaggttcgcaccattctcctgcctcagcctcccggtagctgggactacaggcgcccaccaacgcgcccgccaacgcaccggctaattttttgtatttttagtagagacggggtttcaccgtgttagccaggatggtctcaatctcctgacctcgtgatccgcccgcctcggcctcccaaagtgctgggattacaggcgtgagccaccgcgcctggccgcaaatgaattttttatggctaattgggccttagttaaaaatccctatgtggtcatgtgactggggagctgaggctatgccacctgtgagccccagggatccctttgttacttctagcttaggcttatcttctcttctctgagctgcatgctgccctccatttcagcttgtaagaggtgaggcatcttctttcaaaaatgtaatctgagcatcagtcaccaagtgatactggtaggaggtaaccatatgatagagataaatctcctgctgggaaagaagccaaatcatactagtggccagcttcagtggaatctactcagtaagcatatttcattggagatgaatatgctcagagagaggcagatccacaaagtcatccaaatacttaatgaggcattttctaccataacatatgctcaaagaatttaatgtcaggcatttatacattacttgagttatttaatttaatccttgcatcaacctaacgaggtagggattcttatgatcccttagtttgcaggatgagtaaacaaagcttacagaggttaggtgactcactgtcaaagaacgagtaaaatgagaactgcattctaaccttggaccatgtattagtctgttttcatgctattgataaagacatacccaagattcagtaaattacaaagaaaaagaggtttaatggactcatagttctacgtggctggggaggcttcacaatcatggtggaaggggaaaggcacatcttacatggtggcaggcaagagggaatgagagacaagtgaaagggaaaaccccttataaaaccatcatatctcatgagattgattcactaccatgagaacaataggaaggaaactggccccatgattcaattatctcccactgggttgcccccacaacacatgggaattatgggagctacaattcaagatgagatttcattgggacactgccaaaccatatcagaccattcttttaaaaactgtgctattaaccacggtatcagcagttcccaacgtatcaggccccacactcccaacccctttaaaacaaatatttaagactctctttactatctggaaataaaatatatcaaaaatgtcatttatctacacacaaaactttaaaagttgtacaatgggatactgtttggcaataaaaaggagaaaactactgacactcaaagcaatatggatacatcccaaaaacactgtgttaagtcaattcaaacacaagagtgcattctttgtgattccgtttgtatgatatttaagagcaggcaaaatcaatcgatgggattataaatcagaacactggttgtctttaagaggggagaagggagaggattgacaataaagaggcatgaggtgagtagaatgacagaaatattccatatcttgatggagttttacatgtatgaggtatatatgtgtcaaagttcatcaagatgtgcactcaaaatttgcattttactgtttgtaattatacctcataaaataaaagccaatgtaaaactaattaatttacaggagaaataaaaggattttaacatggtatatatatattaatgtttaggctgatgtatacttgaagacaaaataaaatattcaaatacttccatctgttattaataaatttggattttcaattggtaatttaatattgtcaaaatgttctttttatatcacattttgaagaaatgattcacacatgtatacatagggactcatttagaatgggtcagctgtaaatgcagacaggtacaacgtatcatattgggttcactaatatcatgactactgttgttgaattgatggactactcttggaaaagttcactaaaatttttgcaattttttccctcaatttacacagtagttttaattctggaaaatttagtgaataaactatgaaaaacatattttatatttataaataaaacagttgaatttaaatgtcagataattatacattgagtttttatctgtaagaatttccagatattaaaaaaccatgtgaattgcaggacatgtcttcattatggaagaatttcctctcatggcagtacgccttgtatccctcgcccttgttcttcaaatgcatgtaacactctccccaattattgtgacaactctaaactgcacacatatcgcaaacacctcgaggggagctgtagtagctgagctatactccagatagtactacaaatttaaaactccttctcaagtgccaccccttgtgctaagccttctttaacattttccgggatcattaaccatccttttctgtcctgttagaatcccaatgatatttttgtcttagaaattatcatgttatattttatttttgggaattgttgttctacttgcctatgtctctccctaaattacaaggtccttgaggctggaaatgtttttatctttaacacccaacacagttcaggcatgcatttgttgaaagcatgcatgaatgaattaatataacattgaatgcaaacatcaaatctactgagtccacatgatccacaaaaagaactgaatttatttttgttttattttattatttgttacaaacatactattatatagtatagttgggcttttttaaggattagaacaaactgagattgagaaacaaataattcttttaataagacctcttttgaaacatggtactggcattaaaaaggtaaataagcaggaatattttacataaagaccttcttctcatttccttttactgaaaattaagatgcgataagtgctatatcaaattttaaacccaaggcatctcagtattatgcaatgaacaaaaaatagaggcaagattgcataaagagagctatatttatttgagaaaacaaaatgtgcttcttaagataacgcttggtgtcaccaatgggaaagtctcacacaggccattgtgcccagaagggcagctttgtttcctctgcgcctaaagccttatctgggttcttcttgttatcgataaacaatctgaacttggtcggcattcatagttgctagggatatatatatgtgaccatcctaataattaagtggctctaaaattgtgatgagatgagctttcctgatttccaatccgtcttgctgttgagaagattgaatgacttttcagacctctcagctcttcggaaacaaagaggtacagtgtatgtattcatcaaatctcaggcaagctaccatggctttgctctgcaaatatgagtgttaggatctatgtgtttatttttctcataaaccagtaagggctaataaaattaagattcccagaaaggcccacattttgagatatattttattttactataaatataaacaaaaataaaacactagagaacggtcacagttatatgtatataaagtcccttttgaagatttttttttcttttatatgaaagcacagaattcagatctggtttgggaaagccaaaagcaaaggccagatcatttacaatctcctctataactctttgctgtggtaggaaattattcctgaatgtaattttgctgaagtcttgtctggggcattctggggacaagtttagtggaccctttgggattaccaggtacttgaactcaaggccaggatattctaactttgtcattgtatttggggcattttactgataaggaatctttagaagtctcctgggatagtagttttagggccagctgagaacacttaaatatgtactttaataaataatggaaaaagcctctttttccaaaatgcctttgttcatgtatctcatttctctggacattttctctccacttagaaacatttgtaaagatttttagaaggtatattggatagagtctggaaagcatattgattatttctgaaagaaaatacatagcaactcttaaacaaggggacacattcttatgatatctttgttccataaatcattattagaaataacatttttaggagaaataaaatgagcctacagaattagataagtccaagggttgtaaatatacaatttcttgtgcagtttcctcacacacatgcactgatcaatactctgttaaatagctgagggagaccctttgtacatctcaggggttctctctgtgttcctctttctcctctctggcattcagccctgagaactctagtcacgatattctttcccaattctcagctttttttcaactcaaagagtcggccttcattttccatccttgttggcctgcatttcccatccttgctccagggcctggaagttcccacaagagaacgttggggcagtcataggtcttcctttccatctttcagtcatcactgtcttttgttacctactgtccaatgtctgcaaaactgtcatttaaaattttttcgaatttatttatttatttatttatttattttttgagagggagtctcactccattgcccaggctggagtgcaatgacacgatcttggctcactgcaacctccacctcctaggttcaagtgattctcctgcctcagccttccaagtagctgggattacaggcacctgcaccatgcctagcaaatttttgtatttttagtagagatagagtttcaccatgctgaccagggtggcgtcgaacacctgacctcaagtgattcactcacctcggcctcctaaagtgttgggattacaggtgtgagccactgtgcctgggctcattttgttttttgattgtttcaggtggcactatatctggtttctgttacttcatcttggccttggaatgtcctccatttgtggatttaaaaattataaggaatactttgtgaatttgtaacccatatatagtatgctattacctgttggagtcttaatatctctattgagtgtattagttttatagttctccaatagtaaattacgacaaatttaagcagcttaaacaacacgaatttactatcttatagtattgtaggtgagaatacagtctcacaggtctcacaggcctgaaatcaaggtcttggcaaagctgtattactttttgtaggccctagaagaggactccttgcttatttgtgctggcagaactcaattccttgtacttgtagaactgaggtcctttttcttactgcctgtagactgaggacttttcccagattctttaccacattccttgtccaatgttttcttttcatctactttgaaagccagcaatagtggattgaattcctctcacattgcagtactcagaaaccaccgttttaccttcttcctctacctatttttaagggctcatgtaattagtacagataatctgattaatttccctatcccaaggtccttaaccttagtcacacctgcgaagtccctttttgctggtaaggtaacatccacagattctggggattagaacctgaacatctttggttgtgatgttggtagcgggggaaatattctgcctaccctactgtgctacttcaatgatatcttagctaatatccatcccattttactctgcctgaattattgtttttgtctgtttgccttcagccttttcttcttttcatacgcctttcacattgctgcctaagctatctagccacagcttgccatgaatcctatgttctcactccactgaactatctgcagttttataatcatacaacactattttatgtttcagttactttgttctctttctactctatataaatttttcctaaacatttctgatgataagaatcacatgcgatgcatattgaacataactggcctctactaagaatcagagaagaatttgaaaagttgcatgaacaaaaaaataagtctaattatcaggcaagttttgcagacactgaggaagccccttcctcttctactcttcttcctttccagttgtcaaactcatcttccaggacttattttaggtgttgccttttgaatgaagcctttttggatctcattgtccatgccaatcaaggacaatgtcagttctgaattttgggcctccactgtattgcataatttgtcttcatcgtggtacttatcaaatgcaattacacctattaatttacaactagggatttctctacttaagtataaatctgaacatttttttctagaaatgtttttcaggaacttgcattagaatcatctggattcactaaggaaaaaaaagaacagagaacaaatatttagcccccacttcacacctacctaatcagatgtgctcagggatagaacctagaaatttataattcaatgagttgtatctaatttctctccatatctgtagcacctaggtaatatagagaaagagattctcattgcatgagtctgcagtacaatgatgggagtgtgctgactgaccaagattaaaacaccatgaaaacattaccacaggaatctcccaaaagtccctggaaagaaaaagaatctccaatttgtaaacgtggaaatttacttctaggatagattccaaggatcttgctagaaaaacattaacaaacaagcacatcgaataatccacctgactctgttctgagaaaagaaactttattattatgcaggaaaggaagcatggccctgtgtatcttctatggatccacaggagctagatcataacatgtcttagactactttatctaaattaagttatagaacatagatgccacatttataatgtctggataggctatggtttctctatggctacagactaagatgcctgcagagtaataaactgacttaagatatcaacacctaacaagggtcaccaccaaaaaatgaagctgaatattgataaaaatagccttaaggaaaacaaaatttaaagatggaacatttgaaaactaaatgtgccagttaatgatgatgccaattaatcaagtttcttaagaggaaggatgttcttatttaaaataacatactaaggttgtaaatatcatttggggaataaccacacgatattttaagaacataagctatccaaaacagaatcctgttgttctctaggaattgttaactatataataggcactatctaataacattgtcatggcactcaggaaactcacagtccagtggagaagataaatttgtataaaccagctaaaatataagcagattataataattccataaatagatatgtggttagtatttgaggcatacctttaaaaatggaatacattcaatataggaagttgataaaactagaaagatagaagccaggcacagtagctcatgcttgtaatcctagcactttgggaggctgaggcaggataattgcttaaggccaggagttcaagaccacctgggcaacataacgagaccccatctctacaaaaaattaaaaaaaataaaactagctcagtgtggtggcacatacttctagtcctagttacttgggaggctgaggtaggtggatctcctaagcccaggagttccaggctgcagtgagccatgatcttgccactgccctccagtctgggcaacagagcaagaccctgtcaaaaaaaaacaaaaaacaaacaaacaaaccaaaaaacaaagaagaagagagaaattaccaataccagaaatgaaaaagaggaaatcattacagatctgtcatacacgaaaagatgataaaggaatattataaacaacttaatgatcataaattcactatgtagacacaatggacaaattccttgaatgatacagactataagagctcattcaagaagagacaaataacctgtcttatgtatgtgaacctgtctcatatatatatatatatatatatatatatatatatatatatatatatatatatatacagtcttatatatatgaaattgaatttctctgtggattccctattgaattccatgacttaaggttatactaatacctattctttgtatactcttccataaaatagaagaatagagagctcttccaaactcataacaaaccaaagatattacaaaaaatttctcattaatatagtcatgataatccttaacaaaatattatcaaattaaattaattcatgagtaataagttatggccaaatgggggttgccataggaataaaggtttggctcaacattttaaaatcaattaataattcatcttatcaacagactagaaaacaagaaccatatagtcatcttcccatagttaaggaaaagcattttacaaaaatcaaggtatagttattaaaaaaaaaaaaaaaaacttcagcaatgggaacttcctgaactcaatgaagtgtgcctccaaaaaacctgtaagtaacattatacttgacaatgattgagaattttttccccataagattgagaagaaggcaaagatgtctgttatcatcacttacattcaatattggagagcaaggtaaagtaataaggcctaaataaataaattaaaggcaaaaacattttaaaagtaagaaataaaattatcactattgaagatgatataatttcctacatagaaagtcacaaagtatttacaaatacattactacaactgagtaaataatgcaaggtagaatgctacaaattcaatgtaaaaaatcaattttaattcacataatgataagaaaacatgcaaataaaaatttaaaaatattattttaaaaagttttagaaagctttgactatttagggataaatataagtatatgcaaaatgcatatactggaaactataaaattaagatatacattagataatttagactgacttacaaattctaaaagccaaaattttaaaggtagatgttcattctttctgaactgatatttggattcgattaaaaaaatgcaatcaaatttcagcaggcttttacaaatatacataaaaatccacaagcatattccaaaatgtataagaaaaacaatctaaatagcaaaagaattttgtaaaagaagatggaatttagaaaaatctcacaacttgattttgagatctactataaagctacactaatcaataaagtatggtatggtgtacagatacacgtataaatcaatggaatagatagctcatgaatagatcatacacaagcatcaattgactttcagcaagaagcaaaggtaattgaaggggaaaggattatattttccaaaaatgtagtgcaggaacaatcaggcatccatatgagaaataatgacttttcccttgcaccatacaaaaaaacaacttgacatgggtcatagatctaaatttacaagctaaaattctgaacattttgaagaaaacataaggtaaaaatctttgtgagcctgaattaggcaaagatttcatagatgggtcataaaaaactaaagcgatagaaaattgatatattaaacatcattaaaattaaaatcctctgttctccaaaataaactattaagaacatttaaagccaagttaggaaatggtaggaaaccttgaaaaatttttatttgataaggacttgtgtctagaacaaaggactcttccaagtcaatagaatgatccattcaagaataggcaaaaaatttaacgataattcctcaaagatatataaatgacaagcacatgaaaagatgctcaacattataaattagagaaatgtagattaaaatcatatcagatatcaccaaacacctgttaggatagctaaaatttaagacttgtaataccagttgctagtgaagacacaaagcaaatgcaactctcatatgttgctagcagaaatgttgaatggttcaggccttttattaaacagttcaaaaatttcttttaaatgtattttccaaattgttaattctctctttctttctcaagaatgccaaagaattgaagatttggtctctttacataatctcatatttcctgaatttttgttcattttttaaaattcttttttcttcatattttatctaagttgattcaaaggacgggtaaacattcgcttaccacaataaggcaaaaatccactcctaagttgttaccctagagaaataaaaacagatgtctgcacaaagatctgtatagaatatttatagaagctttattctttatagccctaaattagaaataacctaaatatccattatctgatgagcaaaaagacaaatcaaaaatatcaatgtaatggactattactcagcattaaaaaggaatgaaccacttttataagcagtaatgtgagagaattgtaaaagaactctattaggtatagaaaccaaacaggatcctggggacaagatggctgattagacacaaccagaaagcactgcccctaccaagagaaaccaaggttttaagtaaaccaacatactggactgatcttcaaagagaaaatgctaagaatggataaagatgagatgcagacactgaggctgaagagagaagaggaccctttgttgggtaccaaaatgctgaagctgcttccttgccctaaatggctccttgggaatgggtgagttaagggactgtgggactccctagctttgccatggacctctgggatccaggctacagcgagtcccatatcccccatggacatttaagttgacaggaggttcttcctagagagtagacagagaggagctttagcagtggaggaacccacgggtctttgtgcacagtgcagctttggctgagcatggccacaggcgctcatccctcagagctccccatctccctccgagaagttctagcccctgctgactgacaggcgaggagaaagtggggcatttccctgtgggaccggggcacatctgttcagcaggccctcctgcctgccagctcctcccagggcccctgtctggctgccgtgcgggaacatgtgcacagcacagcctctgctacccggtctggttgcttcgctccaccgattcacttttccagcaggctgagaacactttggattccctagggcacccagaactcgaatccaagggtccagaggtcaaagtcacaagctgatcctggcacttcagggttgcagtgcacagcttgggagtgccaagctgcgatttgtggccagcactcaagtgggagtctacactcccagaaaactgaggggattgagatgcataagttcatgggctagagcaagactaggttgtgcctccttctgcaggattgacctggaactgacctctgcccagggagccccatggcctggaacacctaacagaagaaatgcaggtcagtgccagtgatcagagagggcgtccacgaggcccaggaatggacctggtgaaggagtcacctctttgcctccctctagcaattaacatggctgcaaatgcaaggaaatatagaggagctctgtggctaaaagcctgtttactgcccattactgttaagcaccatctactggatcacagcccaaactataatacatcactaaaaatattttgatagcatattcctttgtgaaaccaagggcaataattcagatgtgaaagaatcagcaagaactctggcaatttcatgtctatggctatatcacctaaaatgtgctgatctcatctgattgagctaaaaagccagtgtccttttacctccaaatgaatccactacctcccaagcaatggtatataaccagtctgagatgactgaaatgagacatatagaattcagaatctaaatgacaaggaagctcattgagatttaggagaaagttgaaattcaatccatggaatctactaaaacaatccaagacaaaatagctattttaagaaagaaccaaactgaaattctagagctgaaaaattcactacaagaatttcataatacactcaatcagaagtattgacagaagaatagaccaagctgaggaaagaatctcagagcttgaagacctgtcctttgaatcaacttaaataaaaaggaagaaaaaataattttaaaaaaatgaacaaaaactcaggaaatatgagattatgtaaagagaccaagtcttcaattctttggcattcttgagaaagagagaataagcaatttggaaaatatatttgaggatatagtccatgaaaatgtccctaatatcactagagaacttgacatgcaaattcaagaaatacagagaaccctgactatgtactatacaagacaatcatccccaaggcatatggtcatcagatttaccaaggacaacacaaaagcaagcatcttaaaggcagctagaaagcagggggaagtcatgtacagagggaaccccattaggctaccagcagacctctcagcagaaaccttataaaccagaagacactggggacctattttcagcatccttaaagcaaagaaattccagtgaagaatttcatattctgccaaactaagcttcataagtgaaggagaaataagatcctcctcagacaagcaaatgctgagggattcattttaactagaccagtcttataagaggtctttaagggaacactaaacatggaatcaaaagaacaacacctgctaccacaaaaacacacttaagcacatagcctatgggcactataaagcaactaaacaatcaaatctacaaaacaaccaactagcaacatgaagacagaattaaagtctcacatatgaatactagccttgaatgtaaatggactaaatgccccatttaaaagatacagagtggcaacaaggataaaaagacaagacccaaccatgtgctgtcttcaggagtgccatttcacatgtaacaacacctacaggctcaaagtaaaggtatggggaaagatatgccatgcaaacagaagacaaaaaagaccaagtcttgctacccttatatctgataaaacagactataatcagactgggcatggtggctcaggcctgtaatcctagcagtttgggaggccgaggcgggtggatcacttaaggtcaggagtttgagaccagctggccaacatggtgaaaccccatctctactaaaaatacaaaaattagctgggcatggtggcgggtgcctgtaatcccagctactggggaggctgaggcaggagaatcacttgaacccgggaggcggaggttgcagcgagccaagattgcaccattgcactccagcctgggtgacaagagcaaaactccatctaaaaaaacaaaacaaaacaaaaaacaaacaaagaaacaaacataaaacagactataaaccaataaaaattaaggacaaagaagggcattacataataataaagggtacaatcccacaagaagacataacaatcctaaatatacacccaacattttagcacctagatcaataaaacaagttcttcttggcctatgaaaggacttagacaaccacatggcaatagtgggagacttcaacacccccctaacagtgttagacagataatcgaagcagaaaacaaagaaactctgaacttttaaactctatatttgaccagttggacctaagagacatccacagaacactccacccaacaattatagaatgtacactcttctcatctgcatgtggaacatattgtaatatgaccacatgctcagtcataaggcaagtctcaataaattttttaaaaattgaaatcatatcaagcacagtctcagactatggtgcaataaaaatagaaatatcagaaggtctctcaaaactacacaaatatatggaaattaaacaacttgctcatgaataactccttggtgaacatcaaaattgaggcagaaattttaaaaaatctttgaaattaatgaatatagagacacaagttaccaaaatatctgggatgcaactaaagcagtgtgaagaggaaagtttaccacactaataccttcatcaagaagttagaaacatctcaaattagcaacttaatattacacctacaagaagtagaagaaaaagaacaaaccaacgctaaagctagcagaggaaaataaataactaaaattagagaagaactgagtaaaattgagtgcaaacattcatacaaaagatcaattaaaccaagagttagttgtttgaaaaaataaacaatattgatagaccactaactatattgtcaaggaaaaaaaaaacagagaagatccaactaagtacaatcagaaatgacaaagatgatattacaaatgaccccacagaaatacaagagatcatcagagagtactataaacaatgctatccacacaaattagaaaatctagaggaagtgattaaattcctggaaacacacactccccgaagattgaatcaagaagagactgaaaccctgaataggttaatatagagatctgaaattgaattagtaacaaaaagcataccaactatagaaagctctggaacatattgtttcacagccaaattctactagacatacagagaagaaccgtaccaatcctactgaaattattccaaaaagaaaaaaaggaggagggtcttctgcttcacgcattctatgaagtcagtatcactcagacaccaaaatctgtcagacacacacacacacacacacacacacacacacacacacacacacacacacgaaaactttaggccaataaccctgataaacataggttaaaaaatcctcaacaaaacactaccaaactgaatccagcagcacatcaaaaagttaattcaccaaaatcaagtaggctttattcctgggatgcaaagctagttcaacataagcaaatcaatatatgtgattcaccacataaacagaattaatagcaaaaccatgtaatcatcccaataaataaagaaaaagcttttgataaaatttagcaccctttcaagataaaaaccttcagcaaactaggcatcaaacgaacatacctcaaaataataagagccatctatgacacatccatagccaacatcatgggcaaaagctggaatcattccccttgagaatcagaagaagacaaggatgcccacttttaccactcctattcaacttagtattggaagtcctagccagatcaatcaggaaagagaaataaagaaatggcatccaaataaaaaaaacaatgagtcaaactgtctctcttcactgacaatatgtatattttatacctagaaaaccctaaatactgacaaaaggctcctagaactggtcatcaactttagtaatgtttcaggatacaaaatcaatataccaatatcagtagcattaatatacaccaataaagttcaggctgagagtcaaatccagaacacaatctcatttacaatacccacaaagaaaatgaaatgcctcgtaatacaactaaccaaaaaggtgaaggatctctgccagaagaactacaaaacactgttgaaagaaatcataaaggacacaaataaatggaaaaacattccatactcatagattggaaaaatcaatatgattgaaatggccacactgcccaaagcaatttacagattcagtgctattcctatcaaactaccaatgtcattcttcatagaattagaaaaaagctattctaaaatttatatggaatcaaacaagaggtggaatagccaaatcaatttttttttttttttttgaggcggagtctcactgtgtcgcccaggctggagtgcagtggtgcgatctcggctcactgcaagctccgccaccacgcccggctaatttttttgtatttttagtagagacatggtttcaccacgttagccaggatggtctcgatctcctgacctcgtgatctgccctcggcctcccaaagtgctgggattacaggcgtgagccaccgcgcctggccggaatagccaaagcaattctaagcaaaaagaaaaaaagccaaagttatcacactatccagtttcagataataccataaggctacagtaaccaaaacatcatggttctggtacaaaaacagacacatagaccaatggaacatcatagaaaactcagaattaaagccacacacctataataatctgatctttgacaaagatgacaaaatcaagcaatggggaaagcactccctattcaataagtggtacagggataattgggtagccatatgctgaaaaatgaaactggacccttacctttcaccatatccaaaaattaactcaagatggatttaatatttaaatgtgtctagtcatggtggctcatgcctgtactcccagcactttgggaggctaaggtgggagaatcactcaagtttacgagtttgataccagcctgagcaatatagggagacctcatctctctacataaaaaaagttagctgggcatggtgcaacgtgcctgttgtcccagctactcgggaggctgttgggggaagatcacttgagcccaggagttcaaggctgctgtgagctgattgtgccacctcgattcagcctgggcaacagagtgagactctctctctcaccatatatatatatatgtatatatatacacacatatatgtgtatatatatacatatatatatataactcatatgatatgagatatatatctcatatgagatatatatatatatatatatatatatatatatatatatatatgatttaaatgtaagacttcagattactaaaatcctaggagaaaacctaggaaatacccttcttgacataaccttggcaaagaatttttgactaagtttccaaaagcaattgcaacaaaacaagaattgacaaatggacctggttaaactaaagagattctgcacagcaaaagaaactatcaacagagtaaacagataacccaaagaatagaagaaaatatttgtaaatgatgcatctaacagaggtctaatatccagcatctataacttaaacaaatcaacagcaaaaaaaaaaaaaatcccattaaaaatgggcaaaggacatgaatgggcacttccccaaagaagccatacaaatggctaacacacatacaaaaaaatactaattatcacttatcatcacagaagtgcaaattaaaaccacaatgaaaaaccatcgcgcaccagtcagaatggctactactaaaacatcaaaaacaacagatgctggtgaggctgtagagaatagggaatacttatacactattggtgggaaaataaatagttcagccactatggaaagcaatttgaacatttctcaaagaacttgcatcagagctaccattcaacctggcagtcgtattacttggtatgtatccaagggaaactacattattctaccaaaaagacacacccacttatacattcatcactgcgtagcaaagacatggaaccaacctaggtgcccatccatagtggactggataaagaacatatggtacatatacaccatagaatactatgcagccattaaaaagagctaaatcatgtcctttacagtaacatggatgcagctggaggccataatcctaagcaaatttatgcaggaatagaacacaaaatattgcatgttctcatttacaagtggcagctaaaaattcagaacatatggatataaagatgggaacaatagacactgctgattagatgggagagggaaggaggggagcataggtagaaaaacttcctattggatgctatgcttactacctgggtgacaggatctgtaccccaaaccttggcatcatgcaatatactcatgtaacaaacctgcacatgcagcccctgaatctaaagtaaaagttgaaattaaaaacaaaacaaaacaaaacaaaacataaaacagacaccagatacaaaggctacatattctatgtccatttagaagacatgctaaaaaaaaggtccctatcctacagggactttaaccagataatttattgttagaagttggggatgggagtagggggttgactggaaagggccataacagaattttatcttattttattttttcacaacagaatttttaaggtgactaaaatgttctatatttggattctggtggtgattccatgactgtacacatttgtcaaaacgtattgaattgtactctaattaacggtacattttacgttatctttatttgtgagaagttaacagctcacttatatgcagggaagaaaatgatcagacatgttgatgtatttttttataccttaataagtttgacaaacaaaataaatatcaagaaggtgctggctgggcgcggaggctcacgcctgtaatcccagcactttgggaggccaaggcaggcagatcacctgaggtcgagagttcgagaccaggctgaccaaaatggagaaaccctgtctctactaaaactacaaaattagcctggcgtgatggcacatgcctgtaatcccagctacttgggaggctgaggcaggagaatcgcctgaacccaggaggcagaggttgcagtgagccaagattgtgccattgaactccagcctgggcaacaagagcgaaactccatccaaaaaaaaaagaagaagaagaaagaagaagaagaagaagaagaagaagaggaagaagaggaagaagaggaagaagaggaagaagaggaagaggaagaagaggaagaagaggaagaagaggaagaagaaaagaagaagaagaagcagctaccactttttcttctcacttgttctaatataatcataaattttcacttcaatgtcccaagtaattttctgatgcatagtcaggggactgcatgactcatacagtgttgtactctcatatagtcaccagatttatatgatttgtgagggaggttgccaacataagaccaacagctgaaggagtcaccaaactgtgagaagcacaaaaaatgccacaccttgtatatttcatgtccaaaatccccgtgcagggggatggtaccacaaaggtaatcacaggagtcagtctccattccaattggaagaagtgctgaatgtcaagcagtgtcttggttctttctccaaaagcctcatgtcctggaggaaaggagttgccatatctgagggtttttacttcctgggcttcagagagaaaggtattatattttttctccaaggcatctagagtaaggagagctagctctgccccggtgtagatagatgcaattccagtcatatttcctagtccacacatctgtagagtgcaataaataagcaaccaattgtgttgtgattagcctgaatttgttaagagaatgtttctatatactatgttaaattttccactttgcaaatgtcccccaaagtgctacagaatacatctgatatattttctggctctctgaagaaaccagtaagtctcaagcaagtcttcatcatctctgtctcaaataataataatttcaattcaacaattacttattgagcccttatgatgttccagatgatagcaaataaagggctagggttcaaaaaataaaagacttgggtctatatcctcaagaagctcacagttattaatatttcttaaaggaaataatgggataatttgatgtattctatatgtttatgatcatatatgagacaaaattttgttttgcctctattcttttgttttctcttgtacttatggataagagaacagagaccacaaacattttttccattccatctttgatccccttccttaactgtcctagatattgtttctatttttcaataaaatattaataacttacagactatattccatgtgtcagcattccatcgaagataaccttattccatgtcttcacatttccactgagggaaggtaatttatatctaattcccataggtggaagtactggaatgaaatctttcgaagtatctattcactcattagaaatatgagtaactgttcttgttaaattggtgagaatttgagatctcttgggtaatgtattttaggcagagttagttcattgaaagacaatatagagtagatactctatttcttatctctgactttattagctctagttgcaccagatgaggtaggcacttctacttcaaccaactacatgctaagtcctctagatctgggccctctgtgttagaaaagcactactctccataatctcttccaggaactggaaaagcatgttagctcatactttccctacagcctaattctcttcaattcaagaagtgatgatgcattcaccaaatttagctcttttggtgggccttgtgttttgaggataattgtcccaaaattattaaaagaaatacttttcctttatttgattccttgttacttttgtttttatttgattcattcaacaaacatttattgaacatctattatgtgctaagtgctgaaaatataatggggaatggaaaagcttttctgaaacattaaaaaatttaaaaacccaagaatataaaaatacaatagggtcatgtgatagagattggctgtagagctctttctattgcatatatagggaagcccgttctaagaggtgctgtttaagcttcatcttaaatgacacagtttaatatgagggagcaactaaatgtgaaggaaacacataagggaagatctggagagtgacactggtggagaaaacagcctctatagaagcccaagagcttaatacagcagaagggagaccagtgagtggttagttgagggaagaagtaagagataaagggcatcctctaaagtaatttgtagtagcactgctgactcccctttttgtttccctcctgtacttattttctattagtgccttccacaactgatttctttctcctgagcctcaatgttttcacattgtattatagaactccctgatataactaatttttatagaatgtaacctttgcacgtaaagtcagaatgagtcatatttttcttccctgaaatatttttagagtgtaataatctgtatttttttgaattctgtatttattttcatctgtgtcactgaatcaaaaattattattcctgatatttgaacccaaaatattcttcattttcacaaaggtgctttaaaacagttacacatcttaaaagacggatgggttattttatgaaactcatgctctttcttgtacttcctattaaaaagaatattatgagcttcctttcttactttttgcctgtctttaggtttctctgggttttatttttgttctttcagtaggcattcttctcggcagtcacaccactatacaattgcagcaggtgacccttagcacacttacaacgtttacagaataaatggttcttcatgcaattatttcccaagagaaaactaatccttgcgtatgtaagtgggattcctcagttaaatatatgtttgacattgccaggtacctaaacagacagttgtttcacccctgaaaatggtctgagtgaaatgcctaaagcattcacagtagtctgaagagaaagtaagaggcatctgtcaggatcctccaaacagttcaacttcctaatcaggccatctgaattcctgagtgaaagataagaaaaaaaccttgcctacccatgagccagtcactcatcagtaataaagcagatgtttaaacaagatacacttagccatgtctgtcagtctgtcatttagtgaaggggtggaggtgcagtgggaaggaagaacagatgagggagaggaagtaaagagtcctgttacacatgagtgcatgagcaattgatgtgccgaaatagaggctaagacttaaagtaacaatgtggcagcctgagacattgttgcagtctgagacaatagctgttaacttactgattttgaaagatgtctagagaaaaagactaggccagtgctagttaagcagacagagagaacacattttatactatctcttatattgattactttggtgggcactaagcacatttggtctggttatgtaagtttttgtaggccatatccagagaagaatttttctaagaagctatttttgtttgtttgtttggctgttttgcagtggaaattatgtgtttggtgtttggtactgggcaaacaattcagtatttctgaagtctgatttccccatctgtaaaatggtgtcaataatacatatcttgttgtaagaactagaaattaagtgtataaaatgcataagaaatatagcattcattagtgttgctggtgtgtcttcttggtagttgggattgttactaataacatattttggggttagtgtaggagcacgagactccaaggagaatgcttcatggaaatgtaataggaatacctgggatcctgggaattgtactaaaccttatgactttgggataagaggctgctatacagcatcactgacccctgaaatgtctaccattttatgttatagaattcagtaagataaaaactgactgaccttaataagatttggatgtctgatgtttagtagacaggtgctgtcctccgattggatctacttttattctttgaatcaccataaccagcaaatcagtagcagtgaactaattgtaaaatatcaagttggaatattccctatagtttccatatagcacttttttttcagaatctcttactgtttggctcctctttgatttcaaaaaatttaacattgaattatcagttttcaggtactggaagaaactgattggagctgagtcatataaaaacaaatggaataaaaagctagccagttgaaaaggcctctggagacttttgtgggaatttatgaaaaaaatctgttgcattaggcaaaaaaatagtttgagggctgataaaatataggatgacttacaaaagttcctgcaaggcaaattgtatgtcagtttattactcttgaacaagcaaaaaagttaattcctacattgtgattttggcaaagaatatctctttaagaatttagtcactaagtgtagaaatttgcatttttttagccttaagagaaagtaatagaagatatatattaaattatcttgtttaatcttcacaaatatatactgaagaaaataccattttttccctattttaaagttgaggaagttgataactgaatagattaggcaacttgacagaagttccatcataaataatggagccaggaatgaaactcagttgtctcattacaatattgaaaaagaagggagtgtaaaacctcaaataacatcagtagctaagggacatggtgtagttacactgatgattaatatcaataatgccattactaagtattacactagtcaatggataaaatattactgctgcatgatagcggcaaaagtgataaaactgtcaagagataagatattcaaagcaaaaagtcactcacgactctgtacctatgtttagaggctttctcacctttcacagtggatactgtatttattatttttaatttctttcctaaatttcagtatggtattattaattttaagctaaactaacattatttttgtaaagtacattttaacaattgtattggaggctgcaataaatttgtcaggtcattctaattgttcattttgcctcggagatgtactctgaagtatgtggaagcaactggtatcacaaaataagagtcatatacataatgaaatacaaacataatgaagtatcatattgttccattacagaaaaaaggagaaacttttatcttttgtgactggtgtaaggaaaatggacatttttcataaacaaaccctagtggtttttattattattattattattatttttttttttaaaagcccaggcctccctcagcctcccaagcagctgggactacaggtacacgccaccacaccaggctaatttttgtatattttatagagacaaggttttgctatattggccaggctggtctcacgctcctgggctcaggcgatccacctgcctcagcctcccaaagtgctgggattacaggcatgggccatcatgcccagcccctagtgtagttttaatgaaatactagtgtattttttatggaaccaaactgttgattcggaagaacgtcttaaagtattattaaatatgaagaaaataatatatctgcagattataatcaataaagcatagttgaacatgttaataaatattttcatatcaatatctacttcatttattcttttatatattcattcattactcaacacacatttaatgagcacatacttatatcagaacctgtgttcgatgtcataaataattgaagaatgaaatagaggagatccttgaaagagcttatagtttctcccagtcacaggaatatagtccataaatgagaatttttttttacatgatagtatgaaatgatgtgaccacagaatcggagttgtatagctcctgggcttttgatggaaactgggtatgttgaaaattatgtgatgttaccatattgctgaggacctaatctatccatatctcatgtgatgctttcacatcattccaacaaatgattacagcacttttttcttcctttttattcgatctaatgatatggtagcatttatggtcaggactaaaactatgaacaagaagtattttgtgatgttttgcctaaaccattcctgacttttcaagaatgcacctcactttttaaagaaataaaaccaatgaacacatttttttaaatttgcttgatttctttgaatgttgacattgttaactatgttgtttttcacacaattttttccttagcttttatgaactttcaatttcttcattaaaaaaaactgccttctgtgtactatttttaatgtgtggcatttaaaaactattgttgagtatatttttgtctgcttttaaaattgtgtcaggagggagtgtaaatctagtttctgtcacttcatgaaggtgggaagtagatatttgagtattcttttaaagtattaaaaacaattttcttggtattggaggaacattcagcatgaacgttgttattattgtacttctacttttttttgattagtgttataatggtagatctttttctatccttttacttttaatcaatatgtgtctttacatttaaagtgggtttttttgtagacaacttatcagtcttgttttctgttccactctgaccatctctgttttaattgtgtatttaaatcattaacatttatgtaattattgatatcattagattaatatctatgatatgtactactgttttctatccattatctttgttcatggatcctattttagtctttcaatctttttctgccttttgtggtttatctgaaaattgtatataattccattttcttttctttcttagcatcttaatgctacttttttatgcttactttagcgatcttcttagagtttgcacatacaattacaactcatctaagtactttttcaagtaatactatactatttcattggtagtgcaagtaccttataacaaaatatttctaactacttcctgccctttgcatcattgctgttattcagttcacttatacgtgagccataaccatcaaatacatggctgctattattactttgaacaaactattatctattagaataaataagaatggaaaaaaagctttcctcttcacttattccttatttaatactcttcctttcttaatgtagatctgagtttctgatgtatatcattctctttctctctgaaaaacttcctttaacatttcattcaagtcaagtttactggcaacacattgtcttaatttttatctaagttttatttctccattgtttttgagggttaatataataaggtatagaattctaggttggtgatttttttctctctctcttaacattttaaatatttaattatattctctttttgcttgcatggtttctgagaagtggaatgtaatttttgtctttgttcctcaataggtaaaaaataatattacttcactttggcttattctaagatttttccctatctttagttttctgaagttttaaaatgatatgcctaggtgcagcttttgttgttgatgttgctttagttttcctggtttgtatttttgtggttttgggtgattttgcggggactgaaggagggttaggaatgtatcctgcttggtgttctttgactttcctggatctgtggcttggtgtttcacattaatttggaaaaattctgagttattatttcttcaaatatttattttcttccttttgtcttttccttctggtattgccattacctcttatgttacatccttcatatttgtctcacagttcttggatattctggatttcctgtcctttggttttttcttagtagtgctttgttttgtcatttttctcttttttagttttggaagtttctactgatgtatcctttagctcagagattattttctagccatgtccagtctgctaatgagtccatcaaaggcattcttcatttctgttacagttttttaaatctctagcacttcttttttattctttcttagaattttcatctttctgcttacattacattgtattcttgcatattttctatttccttcattagagcccttagcatattaaccagagttgttttaaatttccaatctcataattccagcattccagccatttctccatttggttcttgtgttttctctgtttcttcaagctgtgtttttgccttgtatgcaagtcagacatgacgtactgggtaggaggaactttgatatatagacctttcataatgtgatagtaataagtggggggagaaaaagtgttccatttttgttgttgttgttgttgttgttgtttgttttgagatgaagtttcactctcattgcccaggctggagtgcaatggcgcgatctcggctcacttcaacctccacctctcgggttcaaggaattctcctgcctcagcctcccgagtagctgggattacaggcatgcatcaccatgcctggctaattttatgtttttgttagagatggagtttgaccatgttggtcagcctggtctctaatgtctgacctcaagtgattcacctgacccagcctcccgaagtgctgggattacaggcgtgagccactgtacccggccccattgtttttttaaaattaggtcaactttttgtgagcctatgtctctgggctggaaattgtaccagtacttctcagtcctttctctacttctcccttaggtagacaaggacagctagaggaagctggagttgcatgtttctcttccccatgttggttaggctttgataaaactccagcagattaggctctggtaaagcagtttctcttgagagtaggctttgttaataagaacaggatgctttgtcatgtttcaaaatggttatttctccctgcccccaccaaaagtgaaagagggtttttctccagcattacatgtgagaacttggtagagatcttggaggtgaagctcacaaaaaatgtggttgccttttagagtttttaattttcagacttgtgcacattgagcctccagcaattcatcaattagaatttaggtttttctctactggtactggttcctacagaggtttctgcttctgggtttcttctccaatatatatgattctcagggtctgcttgcctgtttcttcaattttgggggcagcagtgtgccctgtgatttcacttccctaatggatataagaaggtgctgatttttcagtttgttcagttttttatttattagaatggaattatgacttccaagagttttacaggtcagagtggaaactggtatctctaaaagtatttatttattcacatttaatgcttttctctgatgctggtatttctagttttattagacttttagcatctgatatggtttagatatttgtcccatccaaatttcatggtgaaatataatccccagagttagaggtagggcctggtgggaggtgttttgatcatggcggcatatccttcatgaatggcttattgccatctccatgatagtgagtgagtccatgcaaaatttgggtatttaaaagtgtgtggcactctcctcacccccacccctgttcttgctctcaccatgtgacatgctggctctcttccaccataattgtaagcttcgtaaggcctcaccagaagcagatgccagcaccatgcttcctgtacaacctgcagaatcatgagccaattaagcttcttttttttataaattacgcagcctcaggtatttctttatagcaatgcaaggatggagtaatacagcatcttaagaaatacggcaatgaattccctgtgttttgacagttttgcagaagaaacagcataactagcactgctgatataattaaggcaactctatgttctgaatgcctaaatgtgtcaggcacttctctaggtattttggtatgtattatgtcatttaattcccatgtacactccctatttttacatgggaaggaaatagattgagagaagttaagagtcttgctaagtttatgctattgatggatgacagttgggtttgaacttggtttttctgactcatgtcatttccaattgataattaaccatgcttcccatctgagtattctttgttctccatttgccgaaatagtcacagttatcattgacattccagaggaaaaaaaattatcctgagaatcttaagtgtactgaaaaaaaaaaaaaggagagaggattctttgttacaatttttttacattttgttatgtttattagagtgaggaattacagtggtgttttttttttaaacaagtggtaaaagttatttccctaaaattatattaatggccagagcaccttgagagacaattatcaatattattctgcatttattgacccccaatttatgtagctactctgcttctatttattatatttaatcactaaaggataaaatactgagtttttgttttctaattggtatttctctgttttataaatcttctgtgtattgttaggtattgtattgtagactgaagtaattttactttgaggaggttagtagccaaagtggacaagaaatgtgatgataggttttcaggaatcatacaccacttttcaattaaaataatataaattatattaatagatgtagaaatatttttgatagatatttttgtattataagagatatatataaatgtgggttgagatttgggcagccagatctcatttgaacttgtccagaccaaaatataagtcattttgtaactaatagagtataaaatcagggtttaacatgaaaccactctaagtaaatctacaaagtggttatagttgaaagagactactgctcttacttttaatctgatgttaatatacttcctatagaattatataaggataaatttcattgttctaaagccaaagattcaggtaggcatcttaattctgccatcagaacactttcatcacactttgttgaagttttcatgagcctcgttcaggaaactttttaaagtgagattcttttgattttggaatcaaatggccgaaagccaaaatacttgaagtagtgacacctttctagttctagaatttctcataggctctgaactggaaagaaatgtgcctttctagcatatttgatactatatttgctgacacatgggacaacaactcaagtggccctccttccatagtaaccttaaacaagtatgcaggtccagtagaaagaacatgagctttgacatgaggcaaatctgcacaaatacatcaactttctgcacctgttttgtcaccttaaaagagtgggcatgataatttcattggaatggtatggggattgaatgagatgatgttactaagtaacatctagtatggtttttggcatatagtagacattgataaatatttgtggcttaaacaaacacatgagaaatttatgtaaaaagtaatcagctatctttctttctgcttttagcagagagaagatgtaaacagaatgtagagttaggtagcaatgtaaaaaataaaacagtagtttgagaaagaaaataaaaaatatatttactacaaaaaaatagtgcctggaaacactcactgtcaaattcatgggataggttgcttgctatttcaatctagagtaaaataatcctttgagaaaaaaacctagtcaaacatggcagagattttgtctatggccccagttcttagcccaattttcaacacgctgatactccggaaaccttcaattgaactcagaagttatggcagtatttaactataacttttgtatgtatttgctatttttgaaaaaaattataaattattttgtcttataattatgaagtcaattctaagaatgtgtctcttctctatataatattgttacaagctatcccatttcacatatttacatgtgactcacaaaaatcttcagactgtggaagccatgcgaatgcaccactcagctctccctttgagaggtaatctgctgcaagcaaggctgcaccacagcattcgcactgacttcacactctccccaggcttctcaacttgcctagattcaggccatttctgcctgactcagaattcctctaagagacagcctttgctatgtggatccctactggcctgactgagactttctcagaggtacactacagcttgaagttcttcctacctaatccttctttcttctctctgttcgctggtgttccgacatgcattatggtctgaggctctaatacctactattgttcctactctcctttatccttcacagctgttcctccaaagaataatgtcttgctcttctaattctatcttaatgtctccttcccagagaacctgaattgaccacagatagactgctaaccaaataattaattattacatactaattaacattatgttattaaatttttcatataactggcaattcctttttatttcaacaatctctataattaataaactaaggctcttttttctatatcatacacttgaagcactctgtagtgaaatgagttattttgtcagagtttcctatagtgattccagatgcccataagaactgtcacaccttgatcttttccatgcatttctaattcatgtcactgacacatgcttattgattatcaattaggtgatcaacataccaaagaaacagtcattagttttataagaatagtttcctattcttaggagaggaggtagacattaaataatcataacaagaaaaatcaaccatgacaagcttataagtgaaaaaggaaaagaggaggagtgagtgaataagattgagaagtagagaagtaggaggggaagaacaacaagaagttatggtatcatgcgagtcaaaagaagagaattctaagtactctgagctcaattgtgttgtacaaggtgaagactgaaaagagtcttttgacttggcagcatgagaatcattggtgacctcatgaaatgagtgtaaatgtgggattagagaaaggtttgatgtatgtgtgatttgatttaatatgagatgaagaagtggagatagaatatgcagaaaattttctgggatttggctgtgaaggagagaggtaaaaagaaatggcatattagcagagttgaaggaggaatctgcaatgtacaagaagagcatgttggtggcctatgacaaggaattggtcaacaaccagaaactaagaagatagcaaagaatgaggatacctggtttttttccatcataactcattctcttacttttaacctaaaatcaaatttcaaatgtccatagcactgttgagaacctgacaatctcagaaactattgacataaagacacatctctccatctgccagtgtgtgaaacctgatagactacatgtagttaaagaggagagcaggtatttgagcagggcagaaactgacctcaggtaagcaaaactgtgtatattttaaaaactatacaagctcaaataatctggaagcaattcatgtctaaaagttcataccattcaactgatttcttaaaactccagagatacccatagaaaacattaagagggaatcaacccctcagaagtttagaatttgaaagactgtaggatatcattctatattttaaatgcttgtagacattattgattatagtgtacattttgcatttagaattgaagcttttttgcttttggattcattattgaggcatgaaaacttgagtgatctctgaggatttcaacatttgcagtgtggtgatgaccgagctgggaaaatctatttgttttgtccctttagttgttaaatatttctcaactcaatgagaattttgaatatatcagaagactgtaaattaaagattacaaattgttgttactgaaccaaaatactaggtgttatgttttttcaggcttattttctcgctctgtttcagattattgttttttgttaaaacgcaaatatagatattattaattgtactctatcaacatagaaaaccaatcaatactaagggtactttgaactctaaccctctatgatgctgcgttgaattccatctataataacctttagagacatggtttcagttttgcatatgtgctttatgaattaggaggtgttgtattgatagaattatagaaatttaaaccaggaagagacttcaggaatcctatactttatggctctcgatactttatggctctcaatctcaatgtgggcttgaaatactatgtaaaattttgttcatatttgcatttgtttagattctcatggctttaatcagattcttaaagtgactaaaattttaaaaaaatctaaaattacattttacagaagagtaaactaatgccttgagaatcaaggcctttccccaaatcacacaaagctctagtaggatgatttacattattatggcatgcttgttactctgaaatccatgaaatcaaaccaaacatattaatatcttctttactgctcaagtgatttgttaggttaaatttgttgcatgctgtactcgactgttaggtactttcgcaaagctttaatttttttatgagaaaaacttaaaatgttagaggaaatagaaatatttgcatttgatgcaaaaaataaacagaaactattaaagtgaagtttatcaaattagatgctgagaagaaatatacattctcatcttgcattgcactgaccctttgctaacatgattagttcaaacctgagaataaatggaatgtgtccactatttttctgtttttctatctcaaaagtgaagtgaatagatatctcgatagagctcagctgccattttcattgacttaatgagtttcttaatgcactccattgtgtctcagtattagagaaacatatggcacatttaacttttaagtatgaatttattaaatgttttattgtgtaattttctcctgtgattttatagtttctttaagaaattatatatatgtatatatatatatatatatatataaaatatggtatgttaatatatatgatatatatgccagttgtactatttgcatgaatatatgaatgaaatggctttatcttcttagaaattaccaataaccttatgttctagaggaaaaggctaaataaacaacataaaagacaacctaattttaaagcatttgtaaatgtttaaggctttttggaaaagtactaacaatatagaaaaaggtgcaacaagaaagtttgggtcagtgattttatttattagagtatcatgaaataattgcatgaatggcctaaggaattaggcataattataatttaaagatattgaaccaataaaggattttttaagagtagaaatgcaattaattagggtttcagaaaaaaaattgggaagagaaacatcaacaaataggcttatttatttatttattggtaatatttgttctgaccctcatttgataatggaattcaagttatatgtcttcacataaatctcattacaccattataaatgactaattatggtaaagctcaacatgagaattaaatcattccctggggccacctgaaagagtccagtgttaactgcattatggcactgggttttgatgtgcagctattattttccaagctttgactttgaagacattgatcaaaaactaccaccttctaccatgcacaataaccctgtcagaggcttgacaacacctcataacaaccaccttacgctcacaaagaaatgaatttcaaaaccaaaagatgtgaatggcaaggagccaggaaggaactggtttaccaaatttacctcttatttagaatccttgttgtgaatgaaagccattttttactcacatggatttttaattgggacacttctaagaaaagctccagaagacagactctggcagggcaaaagataaaaacaaatgacagaaatgtataatatctttgaaagtcagtttcatcatattttacaacaaaaatgagcaaaattatctttttagttcctatagcaattccttctgaagaaatagggattggagatatttaaggaattgatttgtacatcttgtttgtgttcagtcagtggaatatagtaggacctaacattaaaatatatcttttgctttaagctaaacaatttggtttccaaaatgggcatttatgaactgtttttttgcaattatttattttatgaaagcctttaagtatttttctaatgcctaatggcagggtctcaccacaattaccttgagagggaaaaccaaccattgaatccaatatcaggttttgaagggagtgaaaggtatctaacctgaatttggttactctggagagtaaaaggaaagcatgtttcaaatttccagtggtaaaagtatcaacaagaagtttcacttctgttttactgctatttataggggtgtgtgggaaagaaagagaaaggtggaataagaatgccatcattaaagtttgctaagatgagacatgtaaagtatggagttttgaagtttttaaatcctttttaaaacttcatacattctttttaaattgagactgttgttagctgaaagaatagatgcgtttttgggttgctaatgagtcagccagtaagtgccttttctgcataactctgctatgaagaactctacctaacagattcctttgtgagtctgtattacagaggtagttgccctgatttctggggagaatcaggagtttagtaagagttttaatattagactaccttggggatttgtactctgaaaatctgttttcttatttgtaaaattaggataatataattggcttcaataaggtgactgtgaagattaaatgacataatgtatctaaagccctaaccacagagcatgaaacataataagcagctcttataaagtagctataataattagaaagagatgtctgtcatattcagaagattctttaggatggtaacattttatgagagaagttttttggttgtctatagtttttttcttaactaattcacctaggatgcaatgtttaattaaatttcttactaacatgcttcagtatttaatatgtgcttatttattctgctataacttctaatagcaacatagagagctttcacatactttctgaatgaaactgtattgctgtctaaggactgaattgtgaggaaatgtttcacatacattaatttatgaaggtgggttctactcagtgtaagacaaatcacaatgattatctcaatccctaagcatggatttactttaaatatcctatgagttaaaaaaaacaaaaacaaaaaacaagagtttcaaagttctgagccctatttacatggtagagttagccccattaggtcaaagaagctaaataaagagcatagcttttgaacatgtagatatacaattaaccacaatggcaccaaggtttcttgttatagtctttaaatcagcaacactcctttataaagaactgcttaaatcatcacattcacaatagtctgtgtaatttactcaaagaaggatcaggcagggtacgttacaatgattggagcttttgctatgctttgcttcaattccccccagtcatacttaaccagaaatttgcaaaatggtgattatctttctatgaactgaggtgttatagaattattttccttatggagttttgggttatcgctattattttagaaggcagaattggtttcctactaagaaaaaacactgccacttaagagaaaaagaaaaaatacgtgggatgatgatgaaatgagctgtgtattagaattcaaattcatacagccttgttagaaaaaaaaagccaagaacataatcaaaagctttaaaagtatttacaacatttaattcagtacttgtatgtatagcgatttattctaaggaggtaatatgaaatacagaaagtgctttatgcttatatgttcatctcattatttacaactgagagaagatgaaactatgaatgtctaaaactagaagaattaagtaattgtcctatgacgaaataatggaaaattacatagctattaaagttgacatttgcaaaatctgttaaaatgagaaatctttgtgtcacaaaattaagttaaatgtattatatataaacaatattatcataactttttatatgaagaaaaaatgtagaagtaaatacactaacacattaatccatcatattcataagcaactatatgtgtttgtatctaaacattttgaaaaatactgaaatgcattcattggcatgaactgtggagttttgtaagatttttcctacaagaaaaacataaaatactttgatttaacattaatgaaagttgtaaaataaagtaaacaataaaccatgcttaaaaaagaaattacactccaacttatataaaactcaaggttgaaaaacaggaaaagattagtttttagtgtgctggaaattacttctcaaccgtttttataacataaaggcaaagcaatgtgatgttaatgcctattcagccaacttaaatgtaagtcctgtgacatccattctttgttttcaaagacatattgagcatttactatgtactaggaatttagaaaaaaaacatataaaaaaggatacatctccacttatgtatttcttagttatttatgattccaagtaagcatcttcaacttgtgtgaaagagcttgtaaagcaacaaaacagaacacattctattctgtttcacaatttgtatccccctgaaagtgggggaacaatgtctatagcatccaactggtttccagctatcccagagcaaggaatcagagattatgtcctctcaggatgtcttatttcctaagagccacaatactgtggttagttgaagctttggtgtaatgaattatctctccccagcctcatggtatccccagggggatgtaagtactggtaggaatcggttcttagagtgatatttcttggccagttatatatatatcaccaaacatgtccatccctttcccaaaaatactccaggaaagaataatatcccagaggaggccgatttctgctcagacctgaggtgcctagccatttaatgacctacagtccaagggctgaaattcctgtcgtccagcagactgtggcctcccatccatgataatgctcaaatgcattgaagtatcccaggaaaagagaaatagaattcaaaattccctccaaaactgcatatacactttacctttctcttaccaatagtttagctgaggatattctatgatcttttttcttttcatcttctgtcacttgccttcttggctaatttcttgtgatatattgtgttttttcacactcaattatgtaacacaggtatactttgtttctgactaggttcatgttcgtcttctcaaggttttctataatatggatacatcacagtttgttagtctattcatgtgttgatgattgatgttttccaatttgcagctgtacaaataaaactactttaaaatgtcaatgtctttgtatggacatttgattgtttcttttgggtagataactaggaatgtaacggttggatcatatggtagatgatatttaactttttaagaaactgttcatctatttttcaaggtggttgtactattttacatttctaccagcagtgtataaaagtcccagctgcttcatgtccttgtcaatacttggtatgatcaatctttttaattgtagtcattgtgatatgtatacggtagtatttcatgtttggtttaatgtgcatttccctcattactaatggtgtgtagaatattttcttgtgcttattttctatccatatatcttccctgatgacatgtttatccaaatattttgcccactgaaaggattgcttttcctatcaagttttgaatgttctttgtatattctgtgtataagttctttatcagatatatgtgtttcctctattttcttccagtctatggcatgacttttaattatcttaacagagtcttttgaagaagaaaaatatttaattttgatgaagcacaatttattagttgttcttttatatactccaaaattatgtgagaggtgacagtgtcctagcagcccttattcactctcggcgcctccttggacttggcatctgctctggccatgctcaaggagcccttcagcctgctgctgcgctgtgggggcccctctctggggctggcccaggccgaagccagctccctctgttcgcggggaggtgtggagggagaggcatgggcgggaggtgggactgcgtgcgcgggattccggtgggtgcgggctcagtggccccacacttggcgtggcctgccagtgcctgctgggcttgattgggggatgagctccctctgggctgccggagtgcccaggctaggtgctgcaaagtcccgctgcaagtgccattgagaggtgaagctggctgggcttctgggttgggtggggacttggagaacttttctgtctagctaaaggattgtaaatgcaccaatcagcactctgtgcctagctaaaagtttgtaaacacaccaatcagcactctgtgtctagctaattgggtaggggatttggagaacttttgtgtctcactaaaagattgtaaacacaccaatcagcactctgtgtctagctaaaggtttgtaaacgcaccagttagcactctgtcaaaacagacccatcagctctctgtaaaatggaccaatcagctctctgtaaaatggaccaatcagcaggatgtgggtgaggccagataagggaataaaaacaggccaccagagccagcagcagcaacctgctcgggtccccttccacactgtggaagctttgttctttcgctcttcacaataaatcttgctgctgctcactctttgggtccctgctgcctttaagcactgtaacactcactgtgaaggtctgcagcttcactcctgaagccagcaagactatgaacacaccagcaggaatgaacaactctggatgggaggaaggaacaattccggacgtgccacctttatgaactgtaacactcacctcaaaggtctgcagcttcactcctgaagccagtgagacctcgaacgcagtgggaagaatgaacaactctggacgtgccgcctctaagagctgtaacactcaccgcaaaggtctgcggcttcactcctgaagtcagtgagaccacgaacccaccagaaggaagaaactccggacacatctgaacttctgaagaaacgaactccgcacacaccatctttaagaactgtaagagtcaccacgagggtccacggcttcattcttgaagtcagcgagaccaagaacccaccaattctggacacattttggcgaccacgaagggattattgcctatcgccaagtggtgagactatcgcctattgcttgtcggtgagaccatcgcctattgccaagcgatgagtaccatcagatcccttttgcttgctattctgtcctatttttccttagaattcgggggctaaataccgggcacctgttggccagttaaaagcaactagcactgctgccggaataaagacacgggtgtgaggctttctgggaaagggttctctaacaacccctaactcttcggagttgggagtattggtttgcctggaaccagcttccacttttcctgtacttctgggctgagccgagggttgacagagaggaaagccattcagctctgggctcccgacaacaagttggttgaccctgtggccatgagcagaactctcaaaggcatgtcgcccaagtgagagttgcccatctatcctatctatcctgacccttgccccctgggtcctaatgccagcctcttgcctctcttctctgaggctagccctgcttctaaaaactactcctgtctctggtgcttttttagtttctcctataagaatgatttctagtataaacttcaggactctgttaccttctttaggcacccaggctcaccaatcagaaagacataacttttgcccaaagccccattgtaggggggactatctggaattttaggatccctcctcagactagcaggcgtaacaaaactattcctgaagctaggatagggggagcctcagaaattgtatcctttctattcaaataagtgaggacaaaaggcatcactcttccaactctggagatcccttccctctctcagggtatggccctccacttcatttttggggcataacatctttataggacatgggtaaggtcccaatactaacaggagaatgcttaggactctaacaggttttcgagaatgcgtcggtaagggccactaaatccgagttttctcggtcctctttgtggtctaggaggacaggcaagggtgcaggtttttgagaatgtgtcggtaagggccactaaatctgatttttctcggtcctctttgtggtctaggaggacaggcaagggtgcaggtttctgagaatgcatcagtaagggccactaaatcccaccttcctctgtcctccttgtggtctgggaggaaaactagtgtttctgctgctgcgtcagtgagcgcgactcttccgatcagcagggtccagggactgttacgggttcttgggcagagggagaaaaaaacaaaccaaaaccgtggacggttttgtctttcagatgggaaacactcaggtatcaacaggctcacccttgaaatgcatcctaagcctttgggaccaatttgacccataaaccctgaaaaagaggcagctcattttttatgcgctatggcctggccccaatattctgtctctgatggggaaaaatggccacatgagggaagtacaaattacaatactatcctgcagcttgaccttttctgtaagagggaaggcaaatggagtgaaataccttatgtccaagctttcttttcattgaaggagaatacacaactatgcaaagcttgcagtttacatcccacaggaggatatttcagcttacccccatatcctagcctccctataggtccccttcctattaatcataagcctcctctaatctctcctgcccagaaggaaataagcaaagaaatctccaaaggaccacaaaaccccccaggctattggttatgtccccttcaagctgtagggggaggggaatttggcccaacccggatacatgtccccttctccctctcagatttaaagcagatcaaggcagacctgggcaagttttcagatgatcctgataggtacatagatgtcctacagggtctagggcaaacctttgacctcacttggagagatgtcatactactgttagatcaaatcctggcctttaatgaaaagaatgcggctttagctgcagcccgagagtttggagatacctggtatcttagtctagtaaatgatagaatgacagccgaagaaagggacaaattccccactggtcagcaagccgtccccagtatggatccccactgggaccttgactcagatcatggggactggagtcgtaaacatctgttgacctgtgttctagaagaactaaggagaattaggaaaaagtccatgaattattcaatgatgtccaccataactcagggaaaggaagaaaatccttctgccttccttgagcggctatggggaggccttaagaaaatatactcccctgtcacctgaatcactcgagggtcaattgatcctaaaagataagtttattacacaatcagttgcagatatcaggagaaagctccaaaagcaagccctgggccctgaacaaaatttggaggcattattaaacctggcaaccttggtgttctataatacggacgaagaggaacaggcccaaaaggaaaagcaagatcagagaaaggccgcagctttactcatggccctcagacaaacaaaccttggtagttcagagaggacagaaaatggagcaggccaatcacccggcagggcttgttatcagtgtggtttacaaggacactttaaaaaagattgtccaatgagaaacaagctgccccctcgttcatgtccgctatgctgaggcaatcactggaaggtgcactgccccagaggacaaaggttctctgggtcagaagtccccaaccagatgatccaacaacaggattgagggtgcccagggcaagtgccaggtcatgtcatcaccctcactgagccccaggtacgtttaaccattgagggccaggaaattgacttcctcctggacactggtgtggccttctcagtgttaatctcctgtcctggacgactgtcctcaaggtctgttaccatccgagaaatcctgggacagcctgtaaccaggtgtttctcccacctcctcagttgtaattgtgagactttgctcttttcacgtgcctttcttgttatgcctgaaagtcccacacccttattagggagagatgtattagccaagactggagctattatctacatgaatatggggaacaagttacccatttgttgtcccctacttgaagagggaatcaaccctgaagtctgggcattggaaggacaatttggaagggcaaaaaatgcctgcccagtccaaatcaggctaaaagaccccactacttttccttatcaaaggcaatatctcttaaggcctgaagctcataaaggattacaggatattgttaaacatttaaaagttcaaggcttagtaaggaaatgcagcagtccctgcaacaccccaattctagaggtacaaaaactgaatggtcattggagtctagtgcaagatcttagactcatcaatgaggcaataattcctctatatccagttgtacccaacccctataccttgctctctcaactaccagaggaagcagaatggttcactcttctggacctcaaggatgcctccttctgtattcccctgcactctgactcccagtttctctttgcctttgaggatcccagagaccacacctcccaacttacgtggatggtcttgccccaagcatttagggatagccctcacctgtttggtcaggcactggcccgagatctaggccacttctcatgtccaggcactctggtccttcagtatgtggatgatttacttttggctaccagtttggaagcctcgtaccagccggctacactagatctcttgagctttctagctaatcaaaggtacaaggtgtctaggtggaaggcccagctttgcctatagcaggtcaaatatctaggcctaatcttagccagagggaccagggccctcagcaaggaaaaaatacagcccatactggcttatccttgccctaagacgttaaaacagttgcgggagttccttggaatcatgggcttttgccaactatggatccccagatacagcaagatagccaggcccctctatactctaatcaaggagacccagagagcaaatactcatctagtagaatgggaatgagaggcagaaatagccttcaaaaccttaaagcaggccctagtacaagctccagatttaagccttcccacaggacaaaacttctctttatacgtcacagagaaagcagggatagctcttggagtccttattcagactcatgggacaaccccacaaccagtagcatacctaagtaaggaaattaatgtagtagcaaaaggctggcctcactgtttatgggtagttgcggtggtggccgtcttagtgtcagaggctatcaagataatacaaggaaaggatctcactgtctggactactcatgatgtaaatggcatattaggtgccaaaggaagtttatggctatcagataaccgactactgagataccaggagctactacttgagggactggtgcttcaaatacatatgtgtgtggccctcaaccctgccatttttctcccagagaatggggaaccaattgagcatgactgacaacaaattatagtccagaattatgccacccgagatgatctcttagaagtcaccttagctaatcctgaccttaacctatataccaatggaagttcatttgtggagaatgggatacaaagggcagttatgccatagttagtgatgtaaccatacttgaaagtaagcctcttgccccagggaccagtgcccagttagcagaactagtggtacttacctgagccttagaactgggaaaggtaaaaagaataaatgtgtatacagatagcaagtatgcttatctaatcctacatgcccatgctgcaatatggaaagaaagggagttcctaacctctgggggaatccccattaaatgccacaaggaaatcatggagttattgcatgcagtgcaaaaacccaaagaagtggcagtcttacactaccgaagccatcaaaaaggggaaggagaggggagaacagcagcataagcagctggcagaggcagagaaagaccagcagagagaaagagagagacaaagtcaaagaaggaaagagagaaagagacagaaagtcagagagagaggaagcgagagagaaagagaaagagatagaaagtcaaagagaaggagacagaaaggaaagagtgagagagacaaaaaaaagaaaggagaaagagtaaaagacagacaaagagggagtcagaaagagagaaagagagagacaaaggagaagttgaagagaaagaaagagagatggaagtagtaaagaaaaaacagtgtaccctattcctttagaagccagggtaaatttaaaacctataattgataatcagaggtcttctccatgaccctataacactccaataccaccttgttgtcagtgcaaacaagggcatagcccaaaagcactgaggccactgacaacccgtagccttcctatcaaaaatccttaacccatcaggtttcctacaggaaaagcttctcaaatcagacaatgcctttcaaactcttataccaacctctggatttgggcaacatggcttctcccctttctaggtcctgtggcagccatcttgctgttgctcagctttggatcctgtatttttaaccttcttgtcaaatttgtttcatccagaatcgaggccatcaagctacagatggtcttacaaatggaaccccaaatgagctcagctaacaacttctatcaaggacccctggaccgacccactggtccttgcactggcctaaagagttcccctctggaggacactacaactgcagggccccttcgttgcctctatccagcaggaagtagctagagcagtcattggccaaattcccaacagcagttggggtgttctatttacagtggggattgagaggtgacaacgtactagcagccttcgcttgctctcagcacctccttggccttggcgtctgctctggccatgctcaacgagcccttcagcctgccgctgcactgtgggggcccctctctggggctggccgaggccggagctggctccctctgttcacggggaggtgtggagggagaggtgcgggcgggagccggggctgcatgtgtggtgctcgctggccagcgcaggttttgggtgggtgcaggctgggcaggccctgcagttggcatggccagctggcaactgctgggcttgattgggggatgagctccctctggggtgccggagtgtccaggctaggtgccacaaagtcccgtggcgagtgccattgagaggtgaagccagctgggcttctgggtcgggtggggacttggagaacttttctgtctagctaaaggattgtaaatgcaccaatcagcactctgtgtctagctaattgggtaagggacttggagaacttttgtgtctaactaaaggattgtaaatgcaccaatcagcactctgtcaaaacggaccaatcagctctctgtaaaatggatctatcagctctctgtaaaatggtccaatcagctctctgtaaaatggaccaatcagtaggatgtgggtggggccagataagggaataaaagcaggccatgcgagccagtagtggcaacccattcaggtccccttccacgctgtggaagctttgttctttcactcttcgcaataaatcttgctgctgctcactctttgggtccacgccacctttaagagctgtaacactcacagtgaaggtctgcagcttcactcctgaagtcagtgagactacgaacccaccagaaggaagaaactctggacacatctgaacatctgaaggaataaactctggacacaccatctttaagaactgtaacactcaccacgagggtccgcaacttcattcttgaagtcagcaagaccaagaacccaccaattctggacacacatggaccatacttttggtgttgtatctaagaaatctttgcataacccaatgtcacaaaagtgctctatgttttatggttttattacttatatttaggtctataaaccattttgagctaatttttatgtggtgagaagtatggatcaaagttttttttatttagttttgttttgcatacagaaatccaattgttctagcaacatttgttgggaaaaaattatcctttcttcactaagttgtctttccacttttgtctggaatgagctgtatgtttatgtgtgtttctctttctaaactctttcttctaccacaatggttgatttttctatgcttacaccaatattccattgttttgattactataactttgtaataattattgaaaaaaggtaatgttaaccttgtgactttattctttttcagagatgttttggccattataggtctttgcatttccatatgaattttatgagtttgaccatgtatattttaaaaatgaaaattttgattgggattgcatcaatttatagatcaatttagtgaggattatcattttaaaaatgttgagtcttctgacccatgaacatggtatatgtctccatctgtttaaatctttaatttctgtcaataaactttttagttttcagtgcttcatatttatcagatgtatccctaagcattttgtattttgaatgccactgtgaataggtttgtttactaaattcagttcgtgattgtctggttttatttcagtttatagaaatatagctgatttttttatactgatcttatgtcttgtggtcttacaaaaattacttcttagttctagcagctttttttctgttttcataggattttataagtagatgtcacctgcaaatgaagagttttacaccattctttccaatttgaatgtctaactaatttctcttgcctgattgcattagacagaatttccagtatattgttgaattgaagtggtcagagtgaacatccttgtattgtttctgatcttaggaagaatggttttagtcattcaccattaaaagtgctgtttgttctattttttaaatgtataggttatgtaggttgaggaagtcctttctattcttagtttgctgggagttttttttttaaatcagaaatagatgagggatatttgtaacttttataaaaaatgtgatgttagtcttattttgttttcagggtaatgttagcgttataggaagaaccagtaaatattccaggatttaagaaatttttagcagaaggttgtgtataattgatactatttctcccttaaacatctggtaaaattcactagtgcagacatctgattcttgagttttctttctcagaatgttttaagctatgtcaatttattggataaagggcttcaggttatgtatttcttcttaggcaactgtgcttttttaatgaattggtttgttttatctaagttattgaatttaatagcataaagttgtctataatatttctcttttattttctatataatctgtagttctttcacgtgttttattccttacatttcttgattagtgtagagatcagttttattgatcttttcaaagaatcaatttttggctacattttatttttaattattttcttgggttgtttcattactttctcttcagtttttaattatttcccttttgctacttattttggttgaatttaatgctccacttctagtttcccaagttggaaactgaggtcattggtttgagatttcttattaataatataggtgtttagtgatataaatgactccccaaagtatggttttaactgcatcccacaaattttgatatgttgtattttcatttttactcagtttaaataccattttcctttatatttctccttttaatatgggttattttaaaatgtgttattaatttccacacactttaggacttttcttgatttatttcttttattgatttctgtttcaattccattgtggtcaaaaagcatacttcatacaatttgaatccttttattcatccttgcttttatggtcccgaatttgattgattggtaaatgttccatatgcacttcaaaaagacaagcattctgtagttgttgacttgaatgctgtatatatttcactggatctatctgttgacagtgtggctcaaattgtctatatctttactggttttctgcctatactatcaattattgaaggaggatgttgaaatctgaccataattgtggatatatctatttctttttacagttgtttttgtttcttgtattttgaggcaatgttattaggtgcatacgtatttagaataatggtattttcatgaagtaaatattatccctagtaatattacttgctctgaaatctattttgtcttatagtaatagagagctacttcagtgttagggtgaaatatttttttttttcatttcatttcagattttccattgctagtatatcagaaacacaatgatcttgtattagacatgcctgtattaaagtcataaatcattaaagtttaaataatcttagaaattatttaacccaactgtttcattttgcaactgagtaaccgagaccaaaaagatagagttacttttcaacaccacaaatctggtcattggaagtgcccttatcttctgtcagatacactgcttatttgaacccatctctcttgatttcctggccaataatcttttctcctgaaagcactgtcaccacgtaggccaatcacacaaattccaagatgggatacttactatgaaaatggttacatttttaataccaatctaattttggttcaccaacaattttggatacctttcttctatatttgactgaatgtataacaagtctggtttttgagttcatttaagacaaagaagttcttctaaaatataataaaattctcatttagcacttgaaatatcattcctaaatattaatatttaaaactcttttattaagaaaagtaatatatatcgagaacctaggtgttaggaacagtaaaatatgcattttattatatacattatgatttaggtaagttatctcgtttaatcctcaagtaaccatatgattattctcattttacaaatgagaaaattgaggacagagtgagataaagtaacttactaaaagtggatccagaatttgagagcaacactttttgactccaaaaccaccaagacaatgttttccagacctcaattttttggcgatgtatgcattatctgcataattcttcatttaaattgacaaatatttaacttaaatacatttatttaaaaactatttttacttccttggaggaaaaccaatatcactttccataattataagataactttaaaaatcaaataaaaacagaaaaatatcgctaaactctaggtaaacattttacttgctgctctttgttgttgttattgaaaaacacaattaaaaggtattttaaaaatttaaaagacatatttgcattaagctgaacattcccattatgtaacctgaagctcctaaaaagaatagaaaagaaaattgctttctcgttaggtaattcattgtattttaatgatccatttagaactaaaaactcatctctcaaaggacggatgtgagtccacagttagggcatcagtacattttaggcaggagtagcttgaacaaagataaagagttgtgagaaaggttggatatcatagaacccccagaggttaggaattccttgagtggtagttctaaacattgtatgtaattttcaccttcagagtttaagacacagacaaaaagaatcagaatacattacgtagattggagtgtccatctcttttaaaagttccctaggtagttccagttcttaggaagggtggaaaacttctacgataggatgtttgtatgagaggatggtagtggtggtgatggtgttgagtaggttggtaggagaaaggccagatagatcagcaatatctgctctgaatgtgaacaggtggaatggtaaaaatatcattattaattgctatcttagggatggaaaatgaataacttgtccaaggtagttggataccatcttgaagagctggcagagtgctgacgctaccttccattaagaataaacattcatgaattttctatctcagatgctcttttgacttaaacgccttatggtcttttcttataattaaaggcattaaattcatatgtgaagaatgcattcatgacagcatatttaaataatgatctaaacgactttccccaatactttacaatagacataagtatttttgaaacagctttaacacaatcgctgcctataaataggcgcagagaagagtttgataacttttttaaagtagcagtattttaaaatagagtacacacaacccaaattcgcatgtgtaaataaatagaatgcatgaaaagaatctgaatgtgaatcacttcccttagttatttatccattgttttgatgctgtcctaagacccatttaaaataaggcatctttctggtgggtaacaaattcgtagtctatcaagctgggatcccactaacattggccaaactgctgcagacatgaagacttcatctgggaacccgaaaggagaactcaaaatccaaatcttcagactttcttaggagaagcgtggaagtgggaaaaggagaaattcaaactctgcttaatttcaaaagggcagtaaaaggggaggctgcaaaggctagtttacaaaaatagacgtcgagaactcctagggaagcaagtagaaacgggctttttttgggggaggagacatttgcagcccattggacggattccccgccgccctcctcccagaaggtccccactccccgccccgggccctcccccggcttccgcgctgggccgggagcctgggtgggcggggtagcctctctagccttgccttcttggctggaggcacaaaggcattaacttagcgcccggggtctctgccaggctcacgggacagctgcacctctcagcgtctccagctccaggacgcggtcgtcccaactccttccgagtggaaagagtgtaaaacttttgtccgtgcgcgggtggagctcagtaggaccacggcgcgtcctgccccggcttccccagcctcccagcagggttagctgcggtcagcgcactttccacttgggactcccggccagaaatttctcgggaatggagcggtcacagtgtggcagcagagaccgaggcgttagcggccgacctcacttggcccctgggctagtggtggctgcccctccgcccccgtccccggcgttgccggtaccatcggggatgcaggttcccccagcgttcctgcggccgcccagcctctttctgcgagcagcggccgcggccgccgccgccgctgccgccacctcgggaagcggaggctgcccgccggctcccgggctggagagcggggtaggcgcggtgggctgcggctacccgcggacgcccaagtgcgcccgctgtcgtaaccatggtgtggtgtcagcgctcaagggccacaagcgcttctgccgctggcgggactgcgcgtgtgccaagtgcaccctgatcgccgagcgccagcgcgtcatggccgcccaggtggcgctgcgcaggcagcaggcgcaggaggagagcgaagcccgggggctacagaggctcctgtgctcggggctctcctggccccccggtggtcgggcatccgggggcggcggcagagccgagaatccacagtccacgggcggccctgcggcgggggctgcgctgggactgggtgccttgagacaggccagtggttccgcgacccccgctttcgaagttttccagcaagattatcctgaggaaaaacaaggtgagttggtctttgatttactctttgctcaaggaatggttgttctggaaagaaactctgaaacaagccaccgtgtccataggcgggcaggaatagttgtttaaaagaaacactttaagttttggggaactgctcagcaatatggacattaatgagagtgtgagagaccccatcgccttcactttggaggaatttactgttgttccctcaggtgataggatgagataatgaaaaaatgaagcatgggtggtaacaaatgagcaattcaccctaggagtagagttatttactcggaagttgatttgactttcactgtgtgagtagaacttcaagcaggcattgagcgaaaagcttcgtaagaggtgctgtgtttgagtctgctctgtactctttccagacaggatctcactctgttgcccaggctggagtgcagtggcgccattacagctcactgcagcctcaacctccccaggctcaggtgatcctccctgctctggactgttttcagctgtaaaaccagagctgattttgcgtgggaaactctgatagttggggatgcagttctttactacatgttggggcaaacatttgttgcaagcttgatgtggggaagagactgaaatctaccaaaccatcgtctttctttgtttcttcactctaaattgttttcgcaaaatgtaatttgtaaaaccataggtaagaatttcaaagttcaatattagaggttttttatccaaggagttttcattatttttctcttattttttgactgcgagtcagttgccttcatttcctgcgttaggagatatattttagtgaacttcatagccctccacagggcctactaagcagtgaaaatatcattgtgattttttttttgtataagtcaaaaacttatacaaaacttataaagctgtattatatgaaattgtatgatagctatacagtaaactattaattagaaaccttccttgaattatgaaaattgcagatctcaacagattttttcgctcaatggctgcttgaagttctactcacacagtacattcgaaaaattctgtgaattgaaatgaggcattcagttcagagtgaattttgtgtttgcatgtgtcaacttttgcacatattctaatttatttgagtaggcaaaacagactttctacaattcccatgaaagatgaaggtgctaaagagcacagttattaagtaaaagtgctatgaaagagaagtaaaagtgagaattcctgaaactacaccgatagtgaaatggctgacatctccctgtgagacactgatttatgtgatttctagttggtaccaaagtgttctgttttatagagctaattattttactttgttctttgcctcagatgatgccccctcccccataagaagcaagctaatgtttgaaaggttacttcaatagctttctaaattgactggttctcttacacaatagccatgaactgtggtaaaatagtctatttaatttactcattcattagacaaagactaacagtgatttagaagtgaacaagtttttcctacacagaagaaccttatattcaaaagaaggcagactatatgtatccaaaaactacaatgcaaggcttaatatacaatgataaatgcaatagaagtaaagcaagctgtaggacttgagaagacagagagacgatataagtggtattatattttaaagacaccatattttctaaataatcttatgcaaattggtatttcattacatatattgtactgtgagtaaaatataacaagacattattttatgatttcatgcataaattgctatagagatgaaatgttgataattgacatgttcgggggcatgctcattcatatttacaagtaaagtggaatggaggactaatgctaatctatttccacttggcaaatttcattagaaaagtattattgtgttatttaaagttgaaaatcctatagagtgtttgcaatttttgcagtagtgacattctttttttcatatgcttatgggaacagcatataggaacagcattttgaacttcaaaatgctaaattgtatacactttaattttaaaataaactatagctatttctttagaatttagaactgaattcttcttaagaaaactggagaaaactggagtattgcaaatcatatttacaaatcactgtcttaggcaatatttgttttgtgacattcataaacttggtagaaaaaggaagttggacagaattactctgcacactccacttaacagtttactcttacctatatatctctagggtaatagaaaatgtaaaccaaagtaaaagttacatagtaaatatggctattttaatttttgtggtgttaacctagtaaagggtattaacatattcttgtttgattaatatgctcaacatgttgagatagaaaaaccagaactttgtgtaaaagtacttttggaaaattgcccctaacattggaggagggctgtgatttaaagcaaatgcctaatatgttgtttttaaaagacaatttgaggatttgtgtagattgcaataggacagtttataattttcttttacaaacaatttgcttttaaagtctgttattgatatttcttaaggattgaaaaagaaagtacatttcatagaggattatgaaaaataccgtctgtgtcatctctcataaaatgaaatatgcaagctctagtatgatttgggattgacatagcaatagtacttattggtttaaatctgaaatgaaatgaacagtttttttttacattattcaagtaaattaattataacctgaaatatgagataaaaaaccaattgttaaaatttagcattagtgattaaatagaatattcattttcaaactaagattattccttttattccttattcattttattcagttctctttccatagtgtcattctgaaaaaatatcacttagataacaacaaaacttaggtgacatttaggaagatcccacacaaccaagatagaacagacagtgtgccatattggtgttatgcagacaatttggggtaacaatacactctcatcttctgattcctaaatataattgcattttaatattgcatacctttgtgattctgagatgatataatagtatacttttcactattccagcacctgcatttctgaataatcttttaaatttgagttattcattaaaatgtcttggagtgtataaatattactaattaataggagtgaattaattatattatccagcattatttttgagtgagcagtaccacattctgggaagtcttccctgtatttgatttttttttccccctcttctccagaacaaaaagagagtaaatgtgagtcatgccagaatggacaagaagaactgatctccaaatcccatcagctttacctaggatcatcttctaggtctaatggtgtcattgggaaacaaagtatcgggtcatctatttcagaatactccaacaagcctgatagtatcctgtctcctcatcctggagagcaatcaggaggtgaagagagtcccaggtccttatcatcctctgatctggaatcaggaaatgaaagtgaatgggtcaaagacttgactgcgaccaaggcaagccttccgacagtgtcctcaagaccaagagatcctcttgatatccttactaagattttcccaaattacaggcgcagccggctagaaggcattctacggttctgcaaaggggatgtggtccaagccattgaacaggttttaaatggcaaagaacacaagccagacaacaggaacctagcaaactcagaagaactggaaaacacagcctttcagagagcttcaagttttagtcttgctggaattggttttggaactctaggtaataaatcagctttctctcctcttcaaactacttctgcttcttatggaggtgattcaagtctctacggcgtaaatcctagagtaggtatcagtccattaaggctggcatattcttctgcaggaagagggttatctggttttatgtcaccctacctaacacctgggttagtaccaaccttaccttttcggccagctttggattatgccttttcagggatgattagagattcttcctacctttccagtaaagactcaataacttgtggcagactgtacttcagaccaaatcaggacaatccgtaatgtatatgcccattctctctttctggagtttttccagcatacaatacatgcacgtgcacacacatacacacacatccattaatatacttcagtaagtatgtgagtggattatgaggtcttaaaatgctgggttttttttttttcaagcaatataataggtcttagatctgaaaactcttcattaggatttatcaagtgaaagaagtaaatctgaacattatatgtgccttgaataaagctatttcaggaaatatttaatgaattttctccctaaattatcatttgtaaacatttttattttaaaactagtttttattttattgaaaagtggaatttttagtgataaaatacatttgtaagtgtaaagcaatacagcataatagaatagaatataaaccgaaaggaagaactgaacaattaaggcaattctaaataattaccatttcaaaactgtttcttctattcctggttcataggaaagaaaaaagttattcaaagtatttttaaagcatttgatttgcagatgggtgattcgtaataaataaaacatttgagcattttgaatttatatttcctgagtattttatttttcaatcttagcttccatgagtgaaaacaagtgccattaaaaaacatttctctttaaagttgacactgtgtctatgaagtaaattttaggaaataagactgcgccatctcctggccactatcgccaattgcaactgagctctgtagagtatatgaattagaaacattgattccggagaataaccatttttttttcaaatagtcattttggattatactacattaaaatttccatactgtaaagtgcacatctactgtggatgagagttgcagtctttaagtgtgcttatgtctgtatctggggaaatatccttaaaagtttgggacaagaatatatggcagccattctcaaaggtaagaataattttattcagaaaactaaaatagctgctcaaataaatatttattaactgcagatagttgatgcttaatgcactgaggagagatataagatttccaaaggggaaaaactgccatgaagtttcagaggtattcttgcaattttaaaaataatttttgtcctccctctggcgcatttgaaaactatttatttcagtcagtggaaagtccctgaggaaactgcttacaaaacagtttctaggacattttctttgtatgtcatcatttttcttttttgaaggacagtagcttcattgttattattaggaataaatggaagcccactggtggtaaaagatagttgatgaattagagattgtttaaactatttaagcagcatgactcactaaagattttttaaattatatgtatatacgtatgtgtgtatgcatctatatgcacatatataagtctatgtagacatacattaaacccctataggttatattatcatggaggcgtttttcatgaagccagtaagaatgtatttccaaggaatattttgccagcaaatgtgatattaaattacttcagagtatctgatgctgatttaggatgtaaatgtgtttattaggttatgcattaattttaatggtgtgaatataagaaagcagatcttgaaaaatttcgatgtactcaatattcatttattataaaaaagttttatattctaagcctaaaccgtagtacaatgtctagcaagtagttgaaattcaattcatatatactgagtaagaaactcttatatataatagatctctttgagactctgataaaactgaagaactctacaaaatggcgtacagacacacagttttgcatacaatttcactgggttcttgaatctcctaaatggtattcaggttagattccttggtgattcttcagttgtttctattgcattaatccacttattgaatgctatttttctgaaaagtgctagatcctgtagaggatactgaatgtaaaatattgtgctctaaaggaagttacattatacaatagagatatggtttaaaaaaaaatcctagagttactgcattatgtatgtggttttataatgatgtgcttgtatctgagaaactgaattgcttttgaccttgggagaacatccattttgggcagtattcgaatttataaaatagttttataatcataaaacttaatttatataatgccttacacattccatactctttataataatttaaggacttaatcttatcaaataggtcatttgtctaacaactcagtagtatatgaggaaattggggctcagcagtagggttttttctccctaaggttagtaatatgagtcatctgcagtggaattactgtgctcacttcagcaatttcagactccaatgtctgaggaaggattcatgtctgtttttttcattcatggccttgaacagtgtctgatataggttctcaacctatacactagatttccactgactgaaaaaaaataaaagcaagtattagcttaataatttcttcattcaacacctatttaatatttttaataatctatttgtgccatgcactgtgttagacacaagagataaagaaatgattaagatacaagactttgcctcaagttgctcacggtctatattgtgtgtacaaaaacaaccaatcaaccaatgttggtattatttgacagtgttggtacatcaatgagttctttgtaatcttgatatttatatccatggatgctgcttgaagcctgaactcctaagccactaattagtggtgggaagaaagagggggtaaatgctttaagagctagcatataacaaaaatgaattgggtttattctgtatcatatagagggcctaagaggcaaacatttcatagagtattcagaagaacataaggaatgacttttttcacagttaacagctgtccaagagtgtagtggctgcctcgtatgataaagcatctggaactcattgaaaaatgcatgtagaaaataccaatcagagcctgattgatgggatttttaattactgctttaatattgggactgaatcattttgtagctcattagaaacatggaaagtatttgttaaataaataagtcatggaatttcaattctaaggccatgaaaattaaaacaccctaccattatttatcaataaaacacagtgcagttttgctcatcagaattttgcctatgtgatagcctcctgagagtaggcagaaaagaaagacatagaacgcagtgcgtgacttacaagggaataaaactgacagaggttagtgtaaggtatataggcatgagtggggcttaaagaggatatgggagaacactgaagacaaatattagtacaattcctataaggtaaataccaatatgtctttctagaagaagcaattgttttggaattgaggaaacctagaatggatttatctatatgacttggacaggttacttatactctttggacatttatttcttctcagcaaaacaagggtaataatatttaacttgcaagattcgtggagataaaagcttaaataaacggcagagtacagtaatgcttatatacgggatgctaaataaataactctcactgttattactttgtattaagatattatctttgccccctcgtggcagtctctcaacaaagagtactgtaattgcatttaatccacttagtggatgtggagcccaaagggcagccatcactagagcagcgtacaggcttagttccagacttcgtgtttggttgttcatttcataggcgagccacgtgttttgtaacatattctcgtatatgttatttggattattttcagggctttctgaagaaaataaacatcgaaatcatagtttgtgtttatgctacatttattggggttgtcaggaaaacagagtccatgtaatatgtggaaataagggagttatagaaatttaacctaacataaacaaaggaggagcttgaaaatgaatgtctggaagagggaaattggcagataagagaaagattcactcatctacttgaagcactggtgtgggctgacaagtgggaactgaagctctgtgaagtccagcatgtccaatcactcaaatggttcccagccaggggttctgaaggggggctatgggaaaccagtgcctctgtgtaggttctagctctgttggtctgtgagcaaacacctggtggtgaacctgtgccaccatgggtcagtgaggtcagaaggcaggaagacaagctagatgtggagtaaggaaaagtgaagacagcctggaaatcactgggtatctaaccttaatgacttgtgtttcacttctaccttaacaatctcaccataattcctttttctgggccaatctcactttgaacaatacaggaaagggaattctgagaaatgtaatttgcagtcagccaaactgatagtgtagtctagtacagtgtactccttgtcaacacggctttcagagcaaaaacaaaatcattcttttacctgcagttgatataaccatatttcgtacaacaaaaacacactagcccactccccaaaagggaacacacaaagtgacttacctatctgtgggttatgctcatttctgttgtactcagtcaaaccctcctttgaatatcctatagctttaatcctgagatataggtaactactattaataaatcttttgttagactaggagaaaggggaaacacacacacacacaaatacacttactttgaagcaataaatacattgataaatattttttatctactagagccctcatgttcagtcatgggatcataactggtcataagaccacagatgttatttataactgccttcttccactaggcaattcatattttctctgctccctgaaagtgtctcagttaattgtggttccttacttgatagagtgacccaaatcctggttcgtgaagcatctctaccattatagccctgcctctattaggttgttgtagcttttcatgaacttttaccacaaaatattgaaagtctaagtgatgctctggaggatcttctgaatactgggaatgctacccctgcctctttcctgttgtttcagtgtctgaggtgccccaaatagccagtggtagttgcgaattccagtacaatgttgtattctgtcatgaatttcttctttgggaagtaagttctctgaacctgaaaggtcaaaatttgtagagaatctgaacaaaaatattaccagtggatcattaggattaatgtgaaaggagtcattctcatatctaccctatgattcccagactcatgaatcctgggtataggagaaacatcgctacatatttataggtgattcaaagcatatcttacatccaggaagacattattgcagccccataaagtgctttcaccagctggtgccataactgagtcttccaaagaccattccataattttattagaccagctgtttcaggatgaagggaacaggaggataccagtaaattgcatgagcatgagcccaacattgcacttcatttgctataaaatgagtttctttgtcagaagtaatgtcatatggaatactataaaggtgaataaggcattgtgtaaacccacagctggtggttttagcagaaacatcaggagtgggaaaggcaaaaccatatctaacataagtgttttttgttgttgttgtttttcctcagtgagaacaaagaggtactccttcaatgatggaagtgatccaatgtaatcaacctgccaccaggtggctggctggttcctccagggaatggtgctatttcagggactcagtgtagatctttgctcttggcagtttgggtagtcagcagtggctctatccaaactggccttaatgaatggaagtccatgttgctgagaccacgcatagactccatctctgcttccatgatcattctcttcatgagccaactgggcaattatgggaataaaagaatgggtaatcttgtgcatgagatttttaagatattcctcttgggaagctgctcttatttgagcatttatgtaagacaaaaatatcttcatattttgtgcccatttagagaagtctttctgtatactttttctctagaccttgttactgattttccaatcttgtttcttctaacttgcttaccatccagccaaactgttagtcactgctcatgactgattccagatatgtacctctatccatatctcctgccaggcaaaatgaacaatcaggtgtatagcttgaagttcttcccgttggaaaaattttcttcaccactatacttcaaggccacacctgtagtgcctcatcgtccaattcagatagtgccagaatagggcagaaccaactgtgaacaaggataaaattgttcttcctcattctgctgtaatagacagctccacataagagagaggaggtggtgtggcaggaatagaagccatgggaatttaagccactttctatgcaacttatttatgacttacttcaacatctttggaggaaaattcatctattgtttccacttgatgaagtactgctacgtaacacttggcgagtcagacaacaccttgttaatatgaatacttatggtcacctgcttatttgatggccaatactaagtgtcaggactctggtgggaacctgtaacaagaaggaagcagtttctcaaaaggacaataattccctgtgagaaaacaaaacttttctctgaagtctgagaggggtatactgtgaatcacctataaggatctgctgaaggtttcccttaggatctctagctgccataagacacctcaagccccattggatttgctgggttatatggcccacatggcaggagaggttgaatgacagtttggctctgttgcagaaccaccttgtaatctgggcctgactcaaaactgagagcttattggattatttggtaaatggtttaaagtaagatgcccaaatcaggtatctattggaaccaaaatacagagctccacctcttagagatagcaggtgtcagatacacaaacatgttttccatctgataagagatgtttcaatatgcaccaggccctaattcctacaaattccacagatattacatgctcgtgaatgtttatagggtttattcttcaagcctctggcatgcatatctctggacaagatatctagagtattttctaccttctgcttattgggttcaatcagaatgatatctatatagtaggcttgcttgatgtcccgtagaatggagaagcaaacaagttcttggtggcctatctatgtagtagacttgcttgatgtcccatagagtggagaagcaaacaacttcctggtggactacactgtagcagagagctggagagttgaaatagtcttaaggaatgctacgtgcattactgcttctagtggttcttactaacaagtatagagaaaaagtatttatgacatcagcagcctaaaactacaaaaaagaggctgtgttggtttgttccaataaagcaactacatctggaaatacaactgcagttataatcattacctaattaagtttatgtcattccacaagatccatctgccttagccacaggccaaataggtgatttgaatgggaatgtgttaggaccccttccatccttgactgtggcacaaactttggtggtccctctaggaatgtgttattgcttttgtttcactgctttgggagggagaaaagttcttaagactctatttgacatttccaattgtaatagtcctcagtccctgtgtcagagatccaatgtggaaattctgccagtttttgaatatgtatcttccaaagatgctttccagaaatgaggaaataaatgtagaatagatttgggagcccattagactcactgtgagatggacttgaaccaaactgtcattgatgattagaccttactcacctctttaagacctacccagcctggtggaccacagtggcagtttaggtttctagagagtagttattgttcggtaaattctaaaaagtagggttatttttattttcttaatgtatagtctcttggtaaattggtttaggtcctttcggagaaagctaggagaaatatttactatgtaaattactgaaagtgtagcagagtctctacttacaagtacccatcttcactttctgcaagaggctctgggtctataaacaggttcaactctagaagtatgttgaggggtcattactttccttatgataatttgaggcagacttagctttatcagacctagtgcttttccacctatacaaatcaagtgtgactttattaacctgcccacctatttcatttgtagaaacacaattattgattagtcaatgcaaaacatctctgtaggtcatatcattctggtaattgcttcagcacaattttttaaaacatagaattcatgtccatcttgtatctgtaatataagtgccacttcttggatttcacaactcctgggtcacatcatcccttgtgaattcagggagggtattttcctggccacaagtctcacagatatccctggcatacagggaaaagccacaacagaggactttgatgatgatggtgctttctttaccaagggggtaccatcttcgagggtctcctagggaatataatttagaggtgcataagcagttaacatgtaataaatccactccgacttttaatctccaaaacccagtgcacatgatcttgccagagtggcttaatggaaagggcactatggaggtgtctatagaaagcagttttctctatgtagctactacatccgtgagtcctcagccaaacacctgctggtgggaattgggctgctcttggtcgacaagatcagcaattaggaatatacgctaattttctagtggaagagagaaaggacaagttaagacctgctgggtaccgctgaatctttctcactgtaatgacttctgcttcctttctgctttgtaaatcttgtagagttcctctttgggccaactcaaactttgaaacatatagggaaggaaattccgggaaatttagtttccagtcttagccaagttgacagaacaaaatcaagcatataaaatattataaatttcatagtttttcaattgtatagctttatgaagcagtattttttcttactccgaatcaaagcatgggcacatattaaatacagggaatcaataatagtaaatgcctaatgtctttaggctgacctactgttgatttcactagctttaaaaatttattttaagataattttaaaattacttgtcattgtaagaaacagtacagaaacatcccatataccttttacccacttttctccaagagtaacatcttgaataattttagtgcaatgtcacaactaggaaattgacataatccacagaatatgcatgaatttcattcaagacaacatacaaagtcgagatttttgacataggaaaacgtcattttaaaagatcattctcactgtgtggtggagaacaaaggagcaaagaagggagcaaaaacatacatttggaggttgttgtgtaaaccagataagagacgacagtggcttagaagatgattgtaaaaataaaaaaagagttggaggtgtggtaagtagtaataagatggtagatacattttgaatgtagaaaccgtaagatttgcttagggattcgggtgtaaaaaaaagaaaggtaccaaagattcttctacagttttgctctaaacaactggactgaatggtgttcttacttactgagatgagaaagactgtaaatttgttcatttttgtgccattcaggcagcctgaaaattttcaaagaacaattattatactggccagccatctttctggtcacaataggattatattaaaatgtttttaattgaagaaaaaccataacaacttttctttcctctaaccgcctccttttacacgctaagaaagtaaaacgaaagtactgttagtaacttaggagtagaaagtaaaatttcaatggagtattgtgaaaaatacttagaggtgagtgatagttacaaattaactactacacagtgtgatgcagcttaagagactgagaaaaggaaattttcagctttaaatgtattacctttcaaaagtttacaaataatcaaataatttaactcaagaagctaggtaagagtaggtaatggatctgagaaaggagaagggaattatacagggagaagtagagattaataaagtagaaattaaataacaaaggtgcaggtcaaaaaaagcaaaaacttgttctatgaaaagattaataaatagaaaaatctctatagaaaggctcaccaagaaagaaggagagaaggcataaatacataatattataagtgatatgggaggtagaacaagagattcagtagagatgaaataaatcataacaatagtatgaatactaaattttttgaaaacttatgtcaattataaacatttttaggaattatttaaaaattggcaaagttgagaagccaccattaaataagtggaatatgtagtttaaaaaatgcaggcctgtgcttccatgggactgtcagtgccacagtgtttctggcaaggtttaccaaacatgcaaggaacagctaatctctattttatgaaaaatcttttagaatataaaacaagagagaatgcttattaaacttcacattagaggtatatcttgataacaaaacatgacaagtgctgaaaaggaaaatttatttatgcagaaatcttaaatgaaggaaattaagaaatcaaagtcacttgtgtatctaaaaataatacacattaaccatatattcctcaaatacagatatcttattggtgtaattttttacattaacaaattaagaaaaatcttatttatagataaagaaaatatttaataaatttcaaagctaatttttaagaaaccttttagataactagggatgaaaactatgaatagatccagtgataagaaagagacattttaactaattcttactaaactatgagttttaagttgttgaatggttgccatatgcctgtcttttgtgtgtgtgtatgtgtgtgtgtacgtgtgtgtgtgtgtgcatgcgtgtgtgtggtttccctcatgttacagaggacagactgaggaacagagggtcaaggaatctaagttcatgttgcaagtaaagtagaggagctgggagttgaacttcacacttggatagcctctatcccaaatttatgctctgtatgacctgtctcacactaaagtaggtaaagctggtaaattttatacttatttcattactcaggagacatttaatcagtggttcaaggatatcagaagttagcatgttgtgattctcttgttctctcttgctcacaataggtctatcatagtttcagccatcacatttgtgttcttgtaaaaggaagaaagactcagcaaggagaaagatgtgacaccagtcatctactgataaatatttaacaataacgtcaggctactaggtggtggtgaacatatctgattgtagcaattgcctaatcccatggtgtaaatacttgaaccatgactaattttaagctatcaaactgatgtcactgaatggggtttgggaagaaatgtacaccataggttatcttggcaagcatggattggctctagagcatggcttggtggtgcctatatcaggaaagaaaaactatcctacaaatctccagcagaactttgctcatgtctcaatgacaagagtagtgtcacatcacctgctgtagctctaagaaattgtatgttttatttgagcacattgccacctcaaataaaattgtaaggaaatgcctattcattaaagaaccaacagcttctgcctttaatgggaacttccttaatttaatgcagcaaacatcatacttaatggcaactctttagagagatcttaaagtcagaaatatgacaagaagagtcactcatactgcttctattgagcattgtaccagaagtgttagccaatgcagtataatacaaaaattgaataattgttgaaaattaactcaatattttcaattgctatgataaaaaaatcaaagagaaactagaactaaggaaagaattcaacaagatggctggttataagcccaacacacaaacaaaatcagtaacttttctctctctctctctctctatatatatatatataaaaaatatatataaatatatatagaaaatatataaatatatataaatatatataaaatatatataaatatatagaaaatatgtataaatatagaatatataaaaatatatatagaaaaaatatataaatatatatagaaaagttcttgatttatatatatagaaaaatatataatatatacagagagaagttattgattttatatatatattttctatgtatataaaaacaatagctagttagaaaaacatagtagaataaaaaaattaacattcataacagcaacaaaaactgtaaaatgcctaggatcaaagttaactaaatacgtatgaaaacttgaaaaaaattatgaaatgtttctagagaacataaaataaaactttaataaatacttatggaagaacataaatatttatggagaatgctcaatagaagtacaatgctcaattagtaaagttgtctattcttcctaaaataatttgggagacattttgttagatataaaagctgaagagccagaatacttgagttcaaattccacctccacaccttacttgccaaataaccttaggtaagttatttaacttctttgggctttcatctattaaatcagttaaatgggtataatgctaataattttatactccttcatttgatcactcaggtgaccaaaagaatgaatacatgtaagatatttagagcagtacctggcccatttatgtacatatgttttattaacctataaatccaatgcaattccaataaaaatttcaggaacttttgttgagtatgatgcctcaatatgaaaataaaataaaaagccaaaaaaaaaaaaaccacctcagatacaaaacagttctggaaaagaaaagaaaaaattttactatcagacatcagatttccctattagatatccaattagattttttttatcagatggcacatagtaagtattcagtaattatagtcatagtttaggctaattataaagttatactaacagtgtggtaatagacaatcaggtatagataatcaagttagtagaatgtcatagaaacttacccaagtatatatggaactataggataagattcattcatttatacagtgaggaatttattgacaccttctatatcccaggcattcttctgtgcactgggggatacaacagtgagaagactgtcaggatccatgcccttgtgaaattgatgttctagttagtgtgatccgataataaacagacaagtaaatataaactatatcaggtagtgctaagtgttatgaagaaaagtaaagcaagataaaagaatagagaatgctggtggctgggagagtgacagcaatggctatttcagtttgggtggtcagaaaaagccttttcagagaacatggctcatatggtttggttttgtgtgcccactcaaatgtcatcttgaattgtaattcccacatgtcaggagagggaactggtggcgggtgattggatcatgggtactgtttcccccatgctattttcttgatagtgagggagttctcaccagatctgatggtttcaaaagtagcagttttccctctctctctctcctgttgccatgcaagacgtgccttgcttccccttcaccttctgccaggattctaagtttcttgaggcctccctgccatgcagaactgtgagttaattcaatctcttttgtttctaaattacccagcctcaggtagtatctttatagcagtgtgagaacagactaatacaatggcatttgaacacaacggagtaaatggcaaggcaggtatgtagaggtatggggctaaggagaaccacaagcacacaggatggaaacaggaacaagcctaattttacttgcagtatgcatgaacagtgtggttaaaacacaatgtgataaaagaggttggagagagatcagtatggtgttggtggcagcagtgatcaactgaaatatttaaattagtgtgatgtctcagaagccactggacagtctgagcagggaagtcaaggctgggtttacatttcacagggatttgtctgattactttgtaggaaataactgctctgcagtgcaagagaggaagcagggagaacaattatgctattcaatagtctagctgaggactgatggtggctttgaccaggactggagctgtgaccaggactggaggtgataaaaagtcgttggattaatgcttaaattattgatgaactgtgtgtgaggtatgatggaaatagaagtgccaagagtgatgcttgcatttttttctcctaaaagattgtgtgcgcctgtaatcccaggactttgggagaccaagatcagcagatcacttaaggccaggaatttgagtccagcctgggcaacaaggtgagactccatctctactgaaaatacaaaagttagctgggcttggtggcccacacctgtagtcctggcaacttgtggggctgaggtgggagaatcagttaaacctgggaggtggtaggagtgagctctgatcataccactgcactccagcctgggtgacagagcaaaaaccctgtcaaaaacaaaactaaccaaccaaccaaccaaaaaaaaaacaaacaaaaatgcaagtgatttttctatttgctgactttttctttttttacattttaagtttaaggtatctgttagatatccaaactttaggtatcacatagctgttacatatatgaagctagaagtcggaggactagtaggaaaacgagagataaattaggaagttattatatttaaagcaatgggtttgtgtaggatttattaaggagaaagtatagatagagtcaggagaatgatgttcttcagcatccaacatttaaaggtgaggaagaagaggggccagccaagaatatcgaaaagaagtggttattgaaataggggaaacactgtcttagaaaccaaattaaaaaaagggaatggggataatgaattgtgtctgttgctaataaaggtttaatatgatgagaactgagatggatcattgaatctgacgatcttattgtcaagtgcccctaacaagaaaagatttggtagggtaacggtggctaaaacctgattggactgaaggagagaatgggagttgaagaataaaccaaaagtttagttaatgtgtttgaaaatctttttttaaagggtaacagggaactaggatggcagctgaagagatacatggattctaggaagtttcatttgtttttcttctaaggacaatagtatggcatgtttgtgtgtttataggaataatgcagtagagacaatgatgcagagaagtaataatggcaggtgtatagtcttctagtggtaacaggaaatgggattttggggacgagtagaggagatggctttagagaagagcagagacaaccattgtaataagggggaacgaagagtataggcacagaagcagaaggttggtaggtttatgatgaaatatgaaccatttctcctttaagtgcttatatttttttcagtaaaattggaggtgaaagcacaaactaaaaatgagaagaggagaaagaaggcgtgtaatagttatcttggagattaaaagagtgaactgatgatggaaattgcctggtgctgctgagagtctgttgagatgtgttgataaacatttcaattggttttcttcagttatgttctacttattctatagagtcatgtcctcaccttctcccttctcccaatttgcttggattcctcactgattaatcccaaatggaagctggaggtgacaagatattttgatttgtctgtacaggtcaaccttctgggatacagagtggatggggaagaagagttgatctggaaggataaaggtacatatctggtacatcatcatgctattcacaaaagtaaatcccagatagaataaaggcctgtatgttaaaaacagaactttccgattattagaagacaatgtgactatctttatatctaagggggatgaaaatatttttttttaccaaaacagaactatagtaaaattaaaaattttaacaataaaatacaaaataaccgaagacattagaaactacatatataacatacaaaaatatctattcaggatatgtaaacactattaatcaataaaattggccaaataaccaacagttttaatgaactagttggatctttatgtatcaatacggataaatctgaagagaaaactgctgattagaaagaacatctcatgaaataattgtgtatactacaattctattcatgaaaattaagctaaaatacagaacttagaatatattttttatgggtagatatataataaaagtacaaacatatggactggctataataaccatatcagttacctctagaaaaggaaggaaatggaactggtgagtgtaacaggtgtatgaatataatctgtaaggtttcatttctttaaaaatttcaagggtcgcacatggtggctcatgcctgaaatcccaccactttgggaggccgagttcaagagatcgataccatcctggctaacacggtgaaaccccgtctctactaaaaatacaaaaaattagctgggtgtggtggcgggcgcctgtagtcccagctactcaggaggctgagacaacagaatcgcttgaacccgggaggtggagattgaggtgagctaagatcgcaccactgcactccagcctggcgacaaaataagactccatctcaaaaaaaaaaaaaaaaaaaaaaaaaaaaaaattaagaaactctgagctttaaaattttttcaaaataacagagttaatcacttaatttacttaatacaaaaatactgtctcaggctcagatacatgagaatgattagggtcagcattagactgcactaattttaattcggaagaccaaggtttgcagtgtcatggctgacattaaagaattacttcagtacttattccactcccattctttgttgagtaatggctccaaacaagcaagaaatatttcttctcaatttttgcctcccatagcaaaagagagcctttagtattaaaaatattcccaggaatttaggaactgagtagccagagagggttcttaattcatccattaatattaactgattttttaatctaatatgcagcatgcataaaacaatattctgggctatagagaaatacagaaatgacctttgaggacaaaagcaggtggcaataaattaacatttagtaaacacgtccagttggccaggctgtaaacaaatttgacatcacagtcaaaatggagttccttaaatctgatgttttaaaaatataaacttagtatttttttaatttgccagttagaatcttgttttctattaataaaaattaaatattgatgttccaaataagagatttattcgataaagtaattacaacagcgttcgtttttgtcgctttcaccctgaggaaaaagacaactcacacggacaaatttgtgggagcttaagattttgtttagactgtctttgaactttcttttgtctcccttttctgttagcaaagcatttcccatttctctggggttttgttctttctccattttctgattttctgaactgcaagatgcattgggtgacactggagccaaaagcaaggatgtaagatttaactcttgattttgctactttttgtttgatcttgattaacaaagttgattttttcaatgccccaatctcctcatctgacaattagaataataataacacctagccctgaggattgttgactggaaaggaggtagattaagtagtcagtaataatacatctatgtcaatttcttcaacaatgagcagcattacaattctgtaaatgaaatctgtgattttaaaaatatttacaattgagatgataaaacaactcatttgtcattggaaaattgcgctacaccacacaactttgtgcttcaggttttcggatggaggtggctgcagaccttaggtaacgtcagctacctgtgttttcatcctgggtatgtgttcatggttgtactatgccatttacaccttgctcagaatgggtcagctctatgaggagtgatttttaaaatttccacttgagggcgctgtctacttctgtgcgaattgaaataccgcagatgtccaattacacaaggaacgtttttaggcagctggatttaacttgtatcaaacttccaatttattccagtgacacgttggccttccttattgattggtgctccaggaggatggatccttacttgtgctgaacactttatattagacatttcattaaattttattaatcctttcaaatatcttgaggagaatacttatcccaattttataaatgagtaaacaatctgagaaaggttaagtaattctcccaagctgtcctaaccagtgtgtgatgtaaaacttagacttaggcctagatcactcaaagcataaaaccagtttacatctagtttacattcttccatattttctttcttttaaatatatgtgtattatatatttgaacataccatatacacacacatttatataagtgaatgtatgtacatgtatattcaaatatatatgcatctgtgtatgtgtatatatatatatctgtgtgtgtgcatatttgggtatataaaacatatataaatgtaatttataatttggtgggcaaatataatacatttaaatgttatgtataaatatatttacatgtactatataaatggggcttaattgggggaagaacagaaggtatcttatgtataatatataaatattatataaaaatacttgcccactaaattgtaaaattacatttagattttattttaaaacatgtccaaattaaatatcttggtgaagaaaacacagataccactgtttgcctgcagaggaaattctgttttcttgctgtataatgcaataaatgtgctaaggcagagccagcatgcccaactgttgtatcacattggcaagctgtaataaaacgccaaattactgtctagaaacaaaatacatttttgttgttaccaagagttgctttaactaaaaggaaggcaccctagccctttaaataggtaagttcccccccttcccatttcttgcaaaatcgaattaggtaaagactacaatagtatttgcatttataggaaatcaattcccagagcacagtaagccagtaatttacataaaattactatttcccaacataagtaaaagcaaaagggatagtatacatttttatttaatttacaagcaaatgtgtaaatattacccatccaggtaacccagttggtgtttgccacaccaacctcttttttaatggtctccaggttggatgcgattttctcaaacttctcaaactcaagagatcatattaactgaaaggtgattgagaagagcattgaaataattatcttttgagctttgaataagcggtcatggccttcatcatattaaataggaagccattattatatacctgttatgtctgaggcattgtgctgagcagttataaagccctttctgaaagtagggcttggtagggggaggagcagaaggtatttgtatctgaaggggagagctgtgggaatgagagaagtagataccactgaaaagctcagccttaacctcgatgtctacactttgcaaatgttgcctgcacgatgttgtgttgtatccaatgaggtaaatgtgctccaggcatttcaaggagaggaaatggcagtggatggccatagaggtgcatttcttcttactttttggtagtttagcaagaaaccagctcagtaggtctgagttaattcaatagaagaacaggctgataccagagactgaggctccctgccccaccccagctatttctaacagagccacttccctcaccaggaagccactactggtttttggtggcctagcttttccctgcagtactactttgctcctttccctctatgtggaaggttacggaggtggaattctttcctgttgctcttctgtgttatatgcaatgtagctatgcccagcctaagcatagtctcctctgtggaacagatgagactttaagagattgtgtacgctctgccacttgtttgtttctaattaaaaaaaatacattgtacctgagtggcactaatggtatatgtgatcataccccctttacatgacacatctgtttataaaatactatgtgcgagtaagtaggataaagactaccaaataagttataattagagtcacagctaaagcaatctgttcttccaaatctggcatgtcacctgtgctcagaaccatagaaccaactaattcacacctgtggatatgtctgcataaatattccaatggcttgactgactactctgcttgcgatgaaggaacacttttaagagcccagatcatgaaacaaactttgatttaggcccatcaaagtggcatttttttgagaatatatcagtggaagtgttaatgttagataacaatatgttataaattttaacactgacctttaacattccaagagcaggaattgcccgaggcttgctactgtcattgcctctagttctagttaaactagaggctttcatttggtcctccagaggcactactgatgaaatcacttcgagaaatgtcagaattggataaaacattttcgcacacattaggcaggacaggcaaacctggtgggctgatgtcaaaaacataaaaccacatcatggacttgtttgaaatactttgtctgtcatgtctacaaatatagaggcgcgtaagactcatcttcctggctgagacctcacacctcaaaggacatatgggattgatagcattgataactcatgggcttttggatggagatgttgctttccaaaatctggaaacgaaaagggaaaattatgaccttttctttccatgaaaagagttgtattgttctgtgaaaattgcaatcagagagtcagacaaagataaatatataagaaaagtgcttggaacgtaaagcctctatggtaatgacaaccattttagctcgatgaattatataactaaccaactgctttattttttacctgttaacatgaacttgcttgaaaaaaatcaaaaaacataaaaatacatacaataaaagatgtgcttcctttttagtcctttatattagtttcttttgtatacttagttttttcctgcaaatataagcaaatagatgtttattttattcttatcccttgctaatacatttctagctttccacatatttcctggattattttgtacttttaaattgttggggccagggatggtagctcacgcctgtaatcccagcactttgggaggccaaggcgggtggatcacctgaggttgggagttcgagaccagcctgaccaacatggagaaaccccgtctctactaaaaatacaaaattagctgggtatggtggtgcatgcctgttatcccagctactctggaggcttaggcaggagaattgcttgaacctggaggcagaggttacagtgagctgagatcttgccattgcactccagcctgggcaacaagagtgaaactctgtctcaaaaaaaaaaaaaaattgttgctatattatgagatgtctcgattttaatgactgtaatatattcattgtgatttgtaccatttaaaattattttcaaaagtgccctttttgaatttttttttttaacttttaacactttggcctgaattatttcacctctgctgattcatttgatagtagtatcacaattcctttacctttcatttttttgtgtgcatatttgtatggtatgcctttcactattatttcctctctgttttttagaggcagagtcttgctctgtcacccaggctggagtacagtggtgcaattatggctcactgcagccttgaactcctgggctcacaagctcttcctgccttagcctcctgagtagcaaggacttacaggcaagcaccgccatgccctgctatttttttttttttttaagagatgggatcttgttatgttgcccagactggtcccgaactcctagcctcaagcaatccccctaccttggcctcccaaattgctgggactacaggtgtgagtcaccgcatcccatctactttctacatcaacttgttttagtagtatctttgtatacaatatagacttggttcatattttagttcaatctgaaaattgttttctactcttaggtgaattaaagtcttttatgtttgttaaaatggaagatatatttggccgcattgtagctaattttggtcacattccttttgatttaacagtgactactttaatgaatcagctactgtctggttttgagtggagtattactgacctctgtggttgtgaggaaaaaatatgatgagttggtttttaaatccttctgcctggatgtagtaggcatcattttcagtcacatttcattgacacaagcaaattaaagccattttaaaacattttaaagcaggaggagggaaaatatagtcctgtctttgacctggaagcacaagaccaggaatattgttcataggtgtatgattgccaaatgaagctgtctgacattttgatttctgattttcaagctcactatgtgagttactggggtcttgatttgaggatttagttatgctggagatttggtccaaatatttttagacatttcgctctgtcaatgaatgacttggattatatttatgcaactctgaacaaaatatattttggatatggagaaattttgaatatttaaaatacttggctaatggagaaaatggcaatcataacaatgataatgatgaagatgaatataatggggaagataatgacaggaaaaatagtgcttgagaattataatcatcatatgacaaatggcagaacttaaagactaacgatgtttattcaatggcattaggagttatctttttggaataacagcttggaacatcaccggccagaatgctttcacttatagtttatggaacaatctgtttctttgggctcaatttattgcagtatataatttatccttccaattcacatttttctgtttattattgcaaatatttttgttggagtttactcgttaatattattttaaacactggtcattaaaattttgcatctgcagctttaaaattgttgctaaaagtgcttgcaatagcacttgcatggtatcttagttacagtcactgttcaaattacattatttgaatgacttctataaaaataatttttattgctgaagaaaaattgtactgtagatctcctctcaccttcagcataacatataagtcacaaaatgagctaaaattttagagaaaacagatggttgttccttgtattcattaactgaaattagtcataacaaaatgctaattttgatcagacttatgtaatgatacaggccagtatttttctctggtgaaccttaaagaaaaagaaaatatcaattactattatttattgagtatttaatatgtaccagtaattgtatcctatcaataacttaataaagggggaattattatgttcatacccattttctgatgaaaaatcttgtcttactcttcagctagtagaataatggaagtatgattgacacataggaagtctgactccagaatctattgtgtgagagatgaccttgccaccatgcttgacaaactccctatcactgcattcaaattgtattttattccaagataaaaattatcgagacataaaaggaaaaaataaggaccttagtgctcactttgcagttttagatttataaaggtaattttctatttatcttttcatattttgcatcaacaatactttattactaccctaattacgtaccaaatactaagctcctggtaactaggaacctgatttgtttaaaagaaccccatgtttccattcattggagactctgcgttaggcattataccttattaaatcaatatcttttattgtttgtaaactcatatatttggaaagatcataaccattttattggagatataaacatttaggaactgtaatcagctatactaaactgctatcaataatgagtcaactttatatcttcttcatgccagaaatgagttaatttttatgcatattgttttgcttgtagctatttgttttagcacaattggctgaaaaaaactattcttccttctttgaatggttttgacacctttgtcaaatatcagtttctcattaggcatttgagtttacttctggacgctcgattctcttccactgatctacatatgtctctttatagcagtaacacactgtctgattgctgttttgttattttcgaactttggaagtgtgaatcttccttcatttttctgcttcatttttgaaggattgtttaggctcttctggtcctcttgcaattccataaaaattttagaatcagtttctcaattaaaacatcagctggtatttttataggaatttcactgagtctatagattagtttgaggtgtattaacattttaccattgttaagtctctggtctgtgaatacgggatgctgtcccacttatttagaccttccttaatttttctcaacaatttctgtcaacaagttttcctttaacaattaaaagcttaaatgttattgagttttcagagcataagttttgcatttctttggttaaatttattcctattttttattattgcaaatggaactgttttcttttatttttggattattctttacaaattggtaggaatacaattaatttttgcatattgatcttgtattctgaaaacttgttgatgagaaactttattataatagtgtttttgtggattctttaggattttttctgtacacagtgttgctgtttataaacagaatttgtttttgttagtttttctttttccaacctgggtgtgttttattttttctttttgattaattgtcctggtgcaatgtcaaacagaagtgttaaagatggttactttgtcttgtacctgattctagggagaaaaattcagtcattcatcaattagtataatgttaactgtggattttttgtaaatgttcgttgtccagttgagatttccttctattcctagcgtgtggagtgtttttatcatgaaagggtgctgaattttgtcaaatgctttttttctgtatttattgagatgctcatttgatttatttattttgatatgataatttacattgattgtaaattatcagatgtaaaacaaccttgcgtcttgaaataaatcacacttggtcataatttataattcttacaatatgctgctggatttcatatgttagttatttggttgagaacttttgcatttatattcataagaaattttgatctgtagttctcttttcttgtaatatctttgattttggcatcagagtaatgctgaccttaataagggagttgggaggtgttcccttctgttttctggaacagtttgtgaagaacagtttctttgaatgttcagtagaaatcagcagtgaagccatattttcctaggatactttgtggctattttaaaaaatgataaattcagtatcttcacctaggtctattcagatcgtttatttcttcatgaatcagtttcagtagtttgtgtctttctaagagcgtttatttcttttaagttatctaatttgttggtgtacaattgttcaatgtattcatttataatcctttttatttatgtaaggttggtagtaatgtccagtcttttatttctgattataataatttgtcttatctttatcttttggtcaaactaggaaaggctgccaattttgttgatcactttgagaaatttaattttctattctctatttcattaatttccatcgtaatgtttaactttccttctccttactttaggtttactttgctctcttttattcagcggaagtttaggttattaatttgagacatttcttgtatatatttttgtgagatggagactcggtctgttactcagcctggattaataggcatttccacctataaatttttctctaaacattgctttagctgcatcccatgttttgacacattgtgtctttagtttcattcatctcaaaatatcttctagtttcctttttgatatttctcttttggcccattgcttgttttagagagtgttgtttgatttccacatatttgtaattttctttaatttctctttattattaatttttgttatggtattatagtcagagaacataatattacttctatcttttaaaatttattgatgtttgttttatagcctaatatatggtttatcctaagaaatatttcatttattttcacttgagtagaatgtctattctgttgttgggtagaatgttctatgggtatttgttaggtctggttggtttatactgttgctcaagttttctgtttctttattgatcttctctttagttgttttgcctattagtgaaagcaggatatctaagtctccaacaattattttgattgtctatttcttccttcatttggttagtttttgccttatatattttgatgctctgtagttactttttactattagttgttaggtgcatacacattgattatagttatatatcttgctagattaaaaattttattataagaagttcctctttatctctgataactttatcttttgtattaaggtctattttgtccggtattagtatagttaccccagttttcctgtgttgctgctggcctaacgtatcttttttctgttctcttactatttttttgtttaagacaggatatcactctgtcgtccaggctggagtgcagtagcacaatcacagcttaccctagccttgacctcttcagctcaaataatcctcccacctcagcctcccaagtagttgagactatagccatgcaccaccatgctcagctaatttttgtatgtatggtagagatggaatttcgccatgttgcccagtcttgtcttgaactcctgagcttaagcaatctgcccactttggccttcaaaaatgctgggattacaggtagaaggcactacacctgccccatcctcttattttcaatctatttgtgtttttgaatctaacatgcttctcctgtaaatgacatacagttagatcatgttttttaatctagtctgacaatttctgccttttaactgggttagttcccatttaatttgattcttgatattgccagatttatgtctgtcattttgtttttccttttctataggcctcatgtctttttgtttcactttagcttcattaatgattttctcactttttgagctactcatttttagtggtttctccaatgtttatcatatacattttaatttatccgaatcagcttcggattatgctagcttaatatccataatacatagaaatgttacttctatataactctattcccatttctccttttttggtactattattgtgcatgttatgtcttttaatgttacatgccaacaatatattatattaattattactttaccacctatcattatttcttatcccattatagctttactgtgaccaacttcttctgtactgctattgacaaatatattactcacatattacatttccatgtgctataagcacaacaatacattttatattattatgcaattgtgttttaaaaatcttttaactaaagaaatagaaaaaaatatgtcattatggtttcttttataattacatcattactcttaccagtgctctttgtttctgtgaatggaattgctatccaaggtcatttagtttcagactgaagaatcccctttaattttattgtaagtcaggtgtgctagcaacaaattctctcaggttttttgtttgtttgtttgtttgttttgggcactctttatttcacctcaatttgggaatgataattttgctaggtataggattcttggttgacaatttatggtttcactgataactttgaatatgttatcctcctgccacctggcctccactggttatggggtgagatttcagtcatgaagctcattggcgttaggtatgcattatttttattttgctgctttcaacatttttgctttggctctgactttcagcatttttattatggtggatctgtttgtgggtatctgcattttgtcctacttagagtatgttgagctttctggatgtgtaagttatagtttttaataaatttgggaattttcagtcattatgtttttaaaattcttatttctttttctcttcttctggtattcccattataagcaattggtgtgcttaatgttctgcataactctgtatttttcttcattattttttctctctgtttaggcttacataatctctatcaatctatcttcaagtttggtaattctttgctttcttcaaatctagtattcagcacctctaatgcatttcttaaaaatttcagttactgcgctttttattttatttatttatttattcattttttgagacaaggtctcactctgctgcccaagctggagttcagtggtgagatctcagctcactgcaacctctgcctcctggatcaaggggtcctcccacctcagactcctgagtagctgggactacaggcacatgccgcacatctagtaatttctttttttctttttttctttcttcttcttcttccttttttttttttttttttttttttttgtagaaacagggttttgccatgttgcacaggttggcctcgaactcctggtctcaagcaatctgtaggcctcagcctcccaaaatgctagagttacaagcatgggtcactacacctggaatactgcactttttaacttctcatttctatttttctttttaaaaacttcctaactctttgttgatattcgttaatcagtgcagcattgccatcatatgtccttttatttctttaatcatgctttcctgtagttctgtgaacacatttataatggttactttgaaattattttctctaaatctgacatcctcccacactcacaggcagtgtctgttgctttccgtccactctatcccccaccaatatatggatctttgctgtttcttggcatgtctcaaaatacttttttggaaatgatattttagataatatattgtagtaattctgggtattcttcccctccttactggtcttattattgttatttgcttgtttatttgtgtagtaagtggttggattattttactaaaatgtgttctccccgacttctaatattgaacctctgatgttgctcttcagggaggcacagggataacaatagtgcttatagaattctcttccactcttttccagactacacatccagatattaaactccactaattttcagttgattttttgttctcagcagtactttggacatacattcctttacgaactaattaaatcaaattttagctccttcaatggataggatagtttctgcagtcactgttcagatatttgttctgatctcaggaggacttctcccagttttcttatttctaggttctctctgataggatagccagtctatcctgtagtttaggctgtattttcattagatcaatgaatctctcctcaccacaatctccattgttcatgagagtgcctttaggtttaaatttgtctatgttctggtgcaaatgaagtcagttcttttgaaaataaatgaggatccatctgttttccagtttgctgaaaaaatctctgagccaaggtcttaagctgacagtggcaaacacttctctgagtcacgacacttctgttcttgaagctgaatgcttggtggagggatgcagatagcttagagatggaaatggagaatatagaagagcaaggaggaacgctgtgatactgcattagaattacaactatcagagtaaacatcatacacacacacatacacacacatatacacacacaccctcttacatataacaaacggtccattttggggatttttctgacttttcttttgtttcagaagctttagtaagaagagcttctatgcagttttaatcgttgagccaataatatatattgctggcttacttaataaattttacattaaaccagagacaaatgttcatcctctaagcaagcaagttgacttttctttgccataaggatgtatacaaatgtattttcttacatgcacagacagccagattaaaaaagaaaacattaaatgcattaaactctcagctctaagagggtacaaactacatccccttcctgtcaacttttaaagatcaattgactttttgtccttgtgatagtttgctgagaatgatggtttccaacaccgcatgttctcactcataggtgggaactgaacaatgagaacacatggacacaggaaggggaacatcacacaccggggcctgttgtggggtcaggggaggggggagggatagcattaggagatatacctaatgctaaatgaagagttaatgggtgcagcacaccaacatggcacaggtatacatgtgtaacaaacctgcacgttgtgcacatgtaccctaaaacttaaagtataataataaaaaaaagatcaattgagtataatttcaaagttagatataagtttaatcttggagaagttataatcttttctggatatgaaatttgcttttagtataggactaatgatttgtgtgaattctgatttgacatatatttttcactacaatgatgaaccattcacactatatgtggcagaaagcagtgaaaaatggaaagtaaattacattaaaatgaagggtttaaaaaaatctatggtgggtgtagctttaacctattgtccttgtgtgaaaaatgaaggttaccacttatttcttttagagaaattttcaaatacttgagagaaggagggagagagagagagagtcatgagccaagcacattttttttttgttgtttaaattgtttgaggtaatacagggaacttaaaaaaaactaatagcttgatttttttgtctgatacagattatgtaaaataggtacttcaaaatgatatatgatacataatgaatattatttatattattcctcaattttaaatagcaaataatccacatagtatgttaattacatagaaaatgtaaacataccacatttgtccttaagtttattaatactcaaatatctctgtatatcaaaaaaaattgagtaacaataattatttttaacacttaccatgtttattgcttggaggaattaccttactccttaatcatattccagaaatattttgagtttagacttggagaaacaaatttctgtcccagggaagactttaagaaggctctgaagtatgagagaagaaaatcaaagttgttcagtagtatttccatcattaaacctttaaaaatgttagtcaaaatccatttattatttctgaagcctagaagacacagtatggcaaattccccatagtacatattctaaactttgccattcaggtggaactgtttgaaaaaccacattttgtgcttcacttccttccttttcctgagtttattcccttttacttctattggtagcacttaaagtgatccttcctgctttgaacaattcaccatgtaaataaaataacatcaaagaaccagacttaatacactccattccagcatgggctcccacaggttgatctgaaggagactgaagaattaatcacccaggatagaagcctcaagcttttcatatgcttaatgctcaagtcactttcacaaaaaatgctctccttcccttttgtttttatgtttagttttctaaacactgtcattctgtttccgcttcagctccagatccccaggatgtcttggcaccaaacacatgtaaaacagataaacaccttcttgcacactctaacaagtgcagcaattagtctctgagcacagcttgctctccaccatggcaactcatttggtgctgtttgttatcataggaaaacaactttgaatcagcaacatttgtttgattccccagttttcacccctgttggcatggtggcttctgtatatccttttcatatcataagttctgcacctctaagaaatgagctgcacccagcatacagcacttgactcctgtatgtcaccttgtcacattctcttggaactttcagctctgggtaatcttcactccatatgggctgtgataactacttgccatggtgtgaatgatagataatttcagtccggacatttttttctttcctttttttacataatagtagaaacttagcattaataatccttgttatatgtttataaacagcctatattccaagatgcaaaatgttatttgctatatactcaagggggtatatttagcaggtgagagaacacttttcttctattttcttgatgccacagagaggctaaagaatttctctgagttgttgcataaattgtaaagttggatgtaaagtccttataaggtgtttattttatgtattaccttaccttccccaattatattatttcagaagtactggatttttgaagagagtatgcggggctaaaatacgttgaaatttgtcttctgtcctgaagcatggtaaagaaagttatgaataagagtgcctgttttcatcagtgatgtataataaaccatattttcttgtgtaaattagtattattgttattggtggcaaattcatatgggtctgcagtaacctcagttcttgcctcctcagaagaaataatttgaccaaggagggcataaggcagaaggacagaccaaggcaagttttagagcaggagtgaaagtttattaaaaagcttcagagcacattaattttgtatcctgagactttgctgaagttgcctatcggcttaaggagattttaggctgagacgatggggttttctagatatacaaacatgtcatctgcaaacagggacaatttgacttcctcttttcctaattgaataccctttatttccttctcctgcctgattgccctggccagaacttccaacactatgttgaataggagtggcaaaaatcacaagcattcttatacaccaataacagacaaacagagagccaaatcatgaatgaactcccattcacaattgcttcaaagagaatcaaatacctaggaatccaacttaaaagggacgtgaaggacctcttcaaggagaactacaaaccactgctcaatgaaataaaagaggatacaaacacatggaagaacattccatgctcatgggtaggaagaatcaatatcgtgaaaatgtccatactgcccaaggtaatttatagattcaatgccatccccatcaagctaccaatgcctttcttcacagaattggaaaaaaccactttaaagttcatatggaaccaaaaaagagcctgcatcgccatgtcaatcctaagccaaaagaacaaagctggaggcatcatgctacctgacttcaaaatatactacaaggctacagtaacaaaaacaacatggtactggtaccaaaacagatgtatagaccaacggaacagaacagatgcctcagaaataacgccacacatctacaaccatctgatttttgacaaacctgacaaaaactagcaatggggaaaggattccctatttaataaatggtgttgggaaaactggctaaccatatgcagaaagctgaaactgaatcccttccttacaccttatacaaaaattaattcaagatggattaaagacttaaactctttatacatttaagaaatatttattgaaactctactatatgttaggcattgtgctaaaagctaggtaaagtgagtgcactaaagtagatacatactcttctgccttcagatatgttatgttctagtgtatgtgacaagtactaagaaaaataattatacattaagtgttaaaaaggaaataacaaggtgagactgagacaagtggggatggaagggaagtatgttatataaggtaataggggcaactttgcagattttggtttccttggaaatcacagtcactagaaaaaccacactgactatttctgcttatttatgtccttgcattctgttgcaaggagaggataatggtatgggagaaatatgaggtttgatttcagaaaaggttagtgaaaacatgtttttgccttgtgcttaccattcaaggtgtcttggagaaatttgtttttttcgctggacttgtttccttctctgttgtaatgcttattatagaggtacttactcaccaagctgctaagaggtacaacagttgttatcagaatgccaagccaagtatttaaatatgttgataggactgcatttgataacggcacttagcagatctttattggttctgcatatgtcaaaagctagagttccttgacgtgacttagccagtttagtctatgacattagaatgtctgcatctataaatatataagccagacttaggctttcaaagatgctgatgaagagctacagccatttttactttgaatggaacagaatgatttttgttgtaactattatgaagtcaaatttataaacttgtgagaatatgtggtggagctatccagctaggtagtcttggtttcatcctggtgggttcagcgttctctaaacacacactagtgttgcagctgctgtgttgttaggcaatgttattggttttaggatgttggacaaatacctatcaaatgatatgcacagaggattgcatgacaaatatctgatttcaaagatgataggaaacatgaaagcaggggcccaacacttatatacagatgagtacatcttataagttacaggtatttatctggttgtcttaagcaaatgttcgttatggccatcagtttacacattggtactcagctgtacctttagtgatatttccttctattcatccttctttattcccggtataatcattctaagataatgttggtgttaagaggtcaaaagcgggattctatcaaatgctctgaaatatgcaaaaatatggtttacattttctaaagcatgcttgagaggttctaacatctattgattttttgaaggtatctgttacacacagatactaaatcctagccctatatattactgtagaaggtatttaaaaaactgatgaaatgacaaacaaaagattgaatcagctatataccaggaactatgctaaattattttacattacttcttaatttcttaattgctcttatttctagtatttctaccaactctgtatagcctcccaattattcttcaaagtgacccaacctatcatgtctttaattatcattacatgcttagtttttaaagttgctttttcctgttcttggtcatcacttgtgctagtgttctttgctttcaaactgtcttcagaataagtcaacagatattgtggcagcttctcaaatacagtaagtcccaagctaagtaggtcattcctaagtgttctcaatcctccagtaaaagtgttctttttctcagtttctctacttttgtctctgatttttaaaatttttccttgtgtgtcagtctggaatattcaaagtcattttggtttcttttcttgtctttgcgttctttatcaaatctgttcctagattctatttttcctatcaattacatctttaatttacccatttctttgttcttctcaatccataacttagagcttcaaaatctatttccaaattatttttcagtgaacactcttgcctttccttgttgtttctttttttttctttttttccatttattttatcttattttattattattatactttaagttttagggtacatgtgcacaatatgcagcttagttacatatgtatacatgtgccatgctggtgtgctgcacccattaactcgtcatttagcattaggtatatctcctaaagctatccctccccactcccctaaccccacaatagtccccagagtgtgatgttgcccttcctgtgtccatgtgttctcattgttcaattcccacctatgagtgagagtatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgctgcaataaacatacgtgtgcatgtgtctttatagcagcatgatttatagtcctttgtgcatatacccagtaatgggatggctgggtcaaatggtatttctagttctagatccctgaggaatcgccacactgacttccacaatggtcgaactagtttacagtcccaccaacagtgtaaaagtgttcctatttctccacatcctctccagcacctgttgtttcctgactttttaatgattgccattctaactggtgtgagatggtatctcactgtggttttgatttgcgtttctctgatgttctgtttcttatacttaaaataccctcctttcttctctaagtacatgtacgtatattcatcttcccaactcacttaattctatattcttttcagacgattctcatccatctaaatctctgctttctgtaactgaatcctgaatcttcagtgtgagactacgtagtttaatcccttcttaagtccttatttcaattttgtattctcagatataatctccataaagtgaggaactgtacttcttccgtatccctttgatataaagagaagcattaggatgtggtagatgtttatgaaacatttatgggttgaccaaagggctttctcaagactgtgaagaaaaagtaagaaatctctccacacctcaatgttagtcctcagttttattcagtgtggtgtgcagttaaaaacataaagtttggaatgaggtatatttcagaatttgtatcttgactccactacttgcccaagggaattaaatgtgttaagcctaatttttttatttgtgaaataaggataattgtatcaacctcctgctgttgttgcaagggactaaatgagataataatacaaaattgctgaccaacattcgcacattactaatactatacctgaataatttacatggatatctaatttaatgcctacagtgatcttttgcggaacactgaggcatggggctattatcctcttcattttacaaagaaactaaagtatagagattaagtgatttgctcaagattataaagttcacaagcagtgggataggatttgaacccatcattaagttcaaaatatatgctcccgatcagtaaactataatatgtattagcattgaacataatgtccagctcacattgagtattcactatatgatagcagttttattagcatgaagaatgtgtttgcttaacatttgagtgcttgcaaatgaatgaatgaaggaataaacacattctagtctgtcattcttttattaacacagacattcataaactctgtattgtttagcaagatttttcttttctagtaatatattcttcagtaaatgagacaattagggaattcctcattatcagtcctatggtcaaattataagtcaaatatacccttatttatccacacctcaacattatagcaccaagaataaacaaccaactttatagcactaagaataagtatcccatatcttcatttggtttctcaaataggaaatacttaggcggtagtgtcttaagtcttggtggtagaattaactaatataactaccttgagaatggtaattttaccactccaagttttattctccctattccaaaaaaattctttgttttactaggttattatttctattgtttctcccaaagattttcagttaggtctaaatgaggtaatcacatgtattcttattttttgaaacaaagaaagaacccctatgggaacattaatttagttttcaagtattttaataactcaagttgtttattatctgtctccaccaacattttatttctttgtttcttctaacggaaagctttttccttttttttttccctgaaaacaatgtgcaacattcttagaggagggctggcttatttatttatttatttattatactttaagttctgggaatgtgcagaatgtgcaggtttgttacataggtatacacgtgtcatggtggtttcctgcatccatcaacccgtcattgacattaggtatttctcctaatgctattcctcccctaggcccttcacccaagacaggcaccagtgtgtaacgttcccgcccctgtgtccttttgttcttattgttcaactcccacttatgagtgagaacatgtggttttctgttttctgttcctgtgttagttggctgacaagaatggtttccagcttcatccatgtccctagaaaggacaagaactcatcctttttttgtggctgcatagtattccatggcatgtgtgtgccacattttctttatccagtctatcgttgatggacgtttgggttggttccaagtctttgctattgtgaacattgccacaataaacatacgtgtgcatgtgtctttatagtggaatgatttacagtcctttggttatatacccagtaatgggattgctgggtcaagtggcatttcttgttctagatccttgaggaatttccatactgtctcccacaatggttgaactaatttacaatcccaccaacagtgtaaaagcattcctatttctccacatcctctccagcatctgttgtttcttgactttttaatgatcgccattctaactggcatgagatggtatctcattgtggttttgatttgcatttctctaatgaccagtgatgatgagcattttttcatatgtttgttggctgcatgcatgtcttcttttgagaagtgtctgttcatatcctttacccactttttgatggggttgtttttttcttgtaaatctgtttaagttctttgtagattctggatattagccagatgtttgtcagatggatagattgtgaaaattttctcccattctgtaggttgcctgttcactctgatgatagtttcctttgctgtgcagaagctctttagtttaatcagatccattttgtcaattttggcttttgttgccactgctttttgtgttttattcatgaagtctttgcccatgcctgtgtcctgaatggtattgcctaggttttcttctagggtttttatggttttaggtcttatgtgtaagtctttaatccatcttgagttaagtttttgtacaaggtgtaaaaaagtggtccagtttcagttttctgcatatgtctagctagttttcccaacaccatatattaaatagggaattgttccctcattgcttgtttttgtcaggtttgtcaaagatcagatggttgtagatgtgtggcagtatttctgaggcctctgttctgttccattggtctatatatctgttgtggtaccagtactatgctattttggttactgtagacttatagtatagtttaaggtcaggtagcatggtgcctccagttttgttctttgtgcttaggactgtcttggctatataggctcttttttggttccatatgaaatttaaagtagtttttctaattctgtggagaaagtcaatgatagctttatggggatagcattgaatctgtaaattactttgggcagtatggccattttcatgatattgattcttcctatccatgagtatggaatgtttttccatttgtttgtgtcctctcttatttccttgagccataggttgtagttctccttgaagaggtccttcaaataccttgtaagctttattcctaggtattttattttctttgtagcaattgtgaatgggagttcactcatgatttggctctctgtttgtctgttattggtgtataggaatacttgcgatttttgcacattgattttatatgctgagactttgcggaagttgcttatcagcttaaggacattttcggctgagacaatggggttttctaaatatataatcatgtcatttgcaaactgagacaatttgacttcctctcttcctatttgaatacccttcattgcgttattttgcctgattgccctggccagaacttcctatactatgttgaataggagtagtgagagagggcatccttgtcttgtgccagttttcaaagggaatgtttccagcttttgcccattcagtatgatattggctgtgggtttgtcataagtagctcttattattttgagatacggtccatcaatacctagtttattgactgtttttagcgtgaaggggtgttgcattttatcaaaggccttttctgcatctaattgagataatcctgtggcttttgtcattggttctggttatgtgatggattatgtttactgatttgcatatgttgatccagccttgcatcccagggatgaagctgacttgatcgtggtggataagctttttgatgtgctgctggatttggtttacagtattttactgaggattttctcctcgatgttcgtcaaggatattgagctgaaatttctttctttttttttttttttttgttttgagacggaatctctctcagtcatccaggctggagtgcaatggcatggtcttgactcactgcaacctctgcctcccaggttcaagcgattctcctccctcagcctcccaagtagctgggactacaggcacatgctaccatgcctggctaattttttgtatttttagtagatatggggcttcaccatgttaggatggtcttgatctcctgacctcgtgatccacccacctaggcctcccaaagtactgggattatggacgtgcatcaccatgcctggccgaaattttcttttttcgttgtctctctgccaggttttggtatcaagatgatgctggccacctaaaatgagttagagaggagtccctcttcttccattgtttggaatagtttcagaaggggtggcaccagctcctctttgtacctctggtagaattcagctgtgaatctgtctggtcctgggcttttcttgcttggtaggctattaattactgcctcaatttcagaacttgttattggtctattcagggattcgactccttcttggttttgtcttgggagcatgtatgtgtccagaaatttatccatttcatctagattttctagtttattttgatagaggtgtttatagtattctctgatgctagttcatatttctggggatcaatgttgatatctcttttatcccttttttaattttttttattgtatctatttgattcttctctcttttcttctttattagtctggcttgtggtctatttattttgttcgtcttttcaaaaaaccaggtcctggattcattaattttttgaagagtttttcttgtctccatctccttcaatgctgctctgatcttagttatttcttgccttctgctagcttttgaatttgtttgctctaacttctctagttcttttaattgtgatgttagtgtgtcaattttagatctttcctgctttcttctgtgggcatttagtgctataaatttccctctaagcaccgctttagctctgtcccagatattctggtatgttgtgtctttgttcctattggtttcaaagaacttatttatttctgagttaatttctttatttacccagtagtcattcagtaccaggttgttctgtttccatgtagttgtgcagtattgagtgagtttcttaatcctaagttctaatttgattgcactgtggtctgagagactgtttgttatgatttccactcttttgcatttggtgaggagttttttacttccaattatgtggtcagttttggaataagtgtgatttggtgctgagaacaatgtatattatgttgatttggggtggagagttctgtaaatgtctattaggttcatttgttctagagctgagttcaagtcctgtatatccttgttaatgttctgtctcattgatctgtctaatattaacaatggggagttacattttcccactattattgtttgggagtctacgtctatttgtaggtctctaagaactttctttatgaatctgggtgctcctgtatggggtgcatatatatttaggatagttagctcttcttgttgcatcgattcctttaccattgtgtaatcctgttctttgtctttttttacctttgttggtttaaagtctgttttatcagagactaggattgccaccctggttttttttgctttccattttcttggtaaattgtcctccatccctttattttgagcctatgtgtgtctttgctcatgagatgggtctgctgaatacagcacactgaagggtcttgactctttatccaatttgccagtctgtgtcttttaattggggcatttagcttatttacatttaaggttaatattgttatgtgtgaatttcatcatgtcattatcatgctagctggttattttgcctattagttgatgcggttttttcatagtgtcatctttacaatttggtatgtttttgcagtggctggtactgcttttttgtttccatatttagtgcttccttctggagctcttgtaaggcagtcctgttggtgacaaagtctctcagctctcgcttgtctgtgaagtattttatttctccttcgcttatgaagcttagtttggctggatatgaaattctgggttgaaaattcctttctttaagaatgttgaatattggcccccactctcttctggcttgtagggtttctgcagggagatccactgttagtctgatgggcttccctttgtgggtaacccgacccttctctctggctgcccttaacatttttttcccttcatttcagtcttggtgagtctgacaattatgtgtcttagggttgctcttctcgaggagtatgtttgtggtgttgtctgtattttctgaatttgaatgttggcctgcctcactaggttggggaagttctcctggataatatcctgaagagtattttccaacttggttccattctctctgtcacttgcattggtacaccaatgaaacgtaggtttggtcttttcacatagtcccatatttcttggaggcttcatttgttcctttttttttttttttcctaatcttgtctttgcactttatttcataaagttgatcttgaatctctgatatcctttcttctgcttgatcgatttggctattgatacttgtgtatgcttcatgaaattctcatgctgtgtttttgatctcatcaggtcttttatgttcttctctaaactggttattctagttagcaatttctctaacctttttgcaaggctcttagcttccttgcattgggttagaacatgctcctttagctcagaggagtctgttattacccaccttctgaagcctacttctgtcaattcatcaaactcatcctccatccggttttcttcccttgctgatgaggagttgtgatccttcggagaagaggcattctggtttttggaattttcagcctttttgcgctggtttatcctcatctttgtggatttatctacctttggtctttgatgttggtgaccttcagatgaggtttctgtatgggcatcgtttttattgaagttgttgctattcctttctgtttgttaattttccttctaatagtcaggcccctcagctgcagatctggtggagtttgctggaggtccactccagacactttttgcctgggtatcatcagcagaggctgcagaacagcaaagactgctgcctgttctttcctctggaagcttcattccagaggggcacctgccagatgccagccggagctttcctgtatgaggtgtctgtcaacccctgctgggaggtatctcccactcaggaggtacaggggtcagggaccaacttgaggaggcagtctgtccctttgcagagctcgagtgctatgctgggagatctactgctctcttcagagctggccggcaggaatgtttaagtctgctgaagctgtgcccacagctgccccttccccaaggtgctctgtcccagggagatgggagtgttatctataagcccctgactgggtctgctgcctttctttcagagatgtcctgcccagaaaggaggaatctagagatgtggtctggctatagtggctttgcagagctgtggtgggctccacccagtccaaacttcctggcagctttgtttacactgtgaggggaaaactgcctactcaagcctcagtaatggcagacgcccctccctccaccaagcttgagtgtcccaggttgactttagaatgcagtgctggcagcgagaatttcaagccagtagatcttagcttgctgggctccgtgggggtgggatccactgagctagaacacttggctccctggctttggccccctttccaggggagtgaacagttctgtcttgctggtgttccaggcgccactggggtatgaaaaatattcctgcagctagctcagtgtctacccaaatggccacctggttttgtgcttcaaatccagggccctggtggcctagggggctggcacttttaataatggttttacgttccattctacccttttcttttcataagtaaataaaggaacagtttttgatgaagagaatgagagaaaagaatgcacgagtttggcagtatggccatattttcactgattgctgtttcagtgtattgctccaacctgttccaataataaaattattaataattcattggaacctttcttttcatgagtaattagtcgagcagcactgaagaagattctaaaggaaagatgttcatagaccaagaaaagaagtgtgtaaatatgattatgattatcttattttggaaagtgacaatacatactactactttccaccaatcagaggccaacaatagcaacactgatgatttgtctaggctgtggtcatctatttacgctttcgcattcaataaaattgtgcagttactatggcaactggaagtctatagggtttgtttcagaacctgttcttggcagtttatgtgtgtaaatcttctacatactgatatgaggttctagtgctgtgttttattaatttgtatttttcttgcatctcagatgttgtgctattttataaaccatgaagtaaaaaagaaattggctgaagaaacaatttctcttgagaggctgacctaggcgctttagaaacgtttggcttactattgtgtaaacaaagcacaaaacttcttatttcagaaatcttacgtaaacattaatactaatttgcaaaacagggcgcaagcattggatcttttgcaattcacgttcctaagcagcttaataattatttctttcacatggaagttagaaaaacaaatcctagcttccaaagaagaatatgtagccatgaaacgtgtttttcttcttaacatttacacaaaaagcattacactgatagttctgtgaaatgataaactcttctggtaaaagtaaactgcgtcattgtcgccctagaataaaaagacggtggagaaacagctttactaacacttaggatcaatacagcattgacgaattaaactttcttaatagactgctgtatattttacaatctcttataataatattcaatattttatcaaacaaatacttgaaccatgttgaggaagtatgtggttggtgtgggtcagtgtggtctctttataaatacaagtctttagcatgagacagacctgggtttgaaaactggttctgcttcttgctaagtatatcaacttggcctttcagagcatctattaccttatctgaaaaatgcaaataggaatatatatatatttattgggtagattttctgcatagacaaattgtttaagttgtaaaatatacgtaacataaaattttttgaggaaccccacactgtttttcatagcgattgtatcattttacattcctctcagtcatacttgagagttccaatttgtccgtatgtttaccagtaacacttgttattgtttcttaaaaaaatatatactagccattgtaaaggatgtgaagtgatgtcttgtaggtttgacttgcattcctgatgattagtgatactgagcatcttttcacatgctattggccatttgtacatcttctttggagaatgcctattcatgtctgtcatgggataaattgcgtcccctcaaaaatcacatattaaagccccaatagctcaaaatgtaaccgtatctggagataatgtcttgaaagatgtaattccattaaaatgagatcattagggtggcccctgatccaatatgactgctgtcttataagaagagggaatttgaacccaggtgtgcacacacagtaaagacgatgtgaagacagagggagaatatggccatctataagccaaggagagtggcctcggaagaaatctaccttgccaatactttgctgtcagacttgtagcctccagaacagtgagaaatatttgttgcttaagccacccagtctgtggtactttgttaatggcatctctatcaaattaatacaatgtcttcatttatttttaagtgaagttttcattgttgttgttgagttgtagaagatctttatatattctatatattaagccctttatcagtatatgatttgcaaatattttctctcatttcatgtgtatacatcaaatttttgcaaaatatataaaatatctggcttatagataatacacaagaaatgatagctgttgtcaatgagtgcacatttattacatttttaaagtcttccttatttttctttatgtgtttgactttttattgtaaaaatgatacttcaaagaaaaaaggaacattttagtataatggagtctgttgatatcaatagaaaacgtgtaattgtctacttgcagatgacttagtataaatgaaattggtcaaacacagtatctgcaaacgttagtttcaaagaaaatgccaagccaaaaagaagaaacattttagatatcagaccagatatatagacaaagctgactgagtagcatacagcctatgtgagtcaatatagtgcagaaaaagttttaatatggctcaaatcctctgaattgatgatgtaaacatttcaatagataaagtctaaagtagacaacattaatatgttgattagagggggaaaatgccaaattatatatatagcaccgaaaaatataccattatttcctacagataattgcaaatacaaaaacttgtaaattagattaaaatttagtagtttgtatgagcatttttttggcaagtggatgtgattaactggtcaaagaaattgaaggtaaatgctgttttgcaaacaaaaccaaaattagggcaaaacagaaaagctcaaagaagacaagtaagcaaaaaacttccatgttcatattttaaactgcaagttttaccctaggtgagtaaagtgggcatatttatttgggattaggtagtaagatttcattttaaaaagtgttttcttatatgcatttacttgtaaatagcagcaattatttaaatttttttcttgtcatataataagtggatctgttttagttttgtcatttgaaattagaaatttaatacaaaatttttgaggaaaaataagatagataaaagagtaaaataaaatcccagaattttcacttggcaacaattcacctatgatttaccaaaaatctgtatgagtaaccgatttatttgaaacaaatcatcctaaacctagtatcttgaaacaatagcaatcaggtgttttcccagaaatctccaactgagtaactctttgtgaagaagatggcttgtgctgtaagaagcatcagctgaaattgcttgattggaaagctaaagggttttctttcaaaatggctcactcacatggcttggaagttggtgcagactgctggttgctaactcagtcaaggttggggactaggaaccctgtgtcttctctatgtgtgcctctctgcagactcatgagttcccttaacacatagtagttagattttaagagttagcatggcattttttagcctttactaatcaaaaatcatacagcttcatttccaccatatgatgttgactgagataatcacaaaagactacctgggttgaaagagaggattataaactcttccatgtaaaggagtttataatcctccttttcatactcttcatacctcaagaagagtatgtggaacaggtgatgttgtaaccatcttcagaaaatacaatttgctgtgctccacacaatttagattccttccatatgccaaatgcattcatcgattccccaagaactctaaatttcttatcccattgtggcgtgaacttcagtctcagagtccaagatcttgatatttaaaccagagatagcacaattcgttgggaattgatatggtttggatttgtgttcctgcccaaatctcctgttgaattgtaatccccgttgttagaggagaggcctgacaggcggtggttggatcatggggcagatttcccccttgctattctcatggtagtgagttctcacgaggtctgattatttaaagctgtgtagcacctcccccttcactctcttcctcttgctccagtcatgtaagatatgcttgcttccccttctgccatgattgaaagtttcctgaagcctccccagccatgcttcctgtacatcctatggaactgtgagccaactaaaccccttctccttataaattacccagtttcgggtatttctttgtagcagtgtgagaatggagtaatacaggaacattctcttgagtatatttcttcttgatctgaagatctttgaactaaacatacagtatattctctcttttaatacatatgataactgctatagacactcttcttcaaaagcaggaaaacggaaggctcacaacaggtccatagcagctctgtttaagctggatccgtattaccagaatctctgtgtattagtttgttctcatgctgctataaggacatacccaagactggttaatttataaagaaggaggtttaattaactcatagttctgcagggctgtggaggcctcaggaaacttacaatcatggcggaaggggaagcaaacacgtcttccctcacaaggtggcaggagagagaagaatgagagccaagcaaagggggaagtcccttataaaactatcagatttcgtgagacttatttcctaccatgagaacaatgtggggaaacctccccaatgattcatttacctcccgcggggtccctccctccgcatgtggggattatgggaactacaatttaaggtaagatatgagtggggacacagccaaaccatatcactctaattagggctaactcattctttggtggttgttctctgtgactctttgttctgccctctaggtactttgttccaccatttgtattatccttttttttttcttttagaaaaatgagtttcaacttaattgtcttctaagcctgcttcctgcctataatgtttgacatccaaaaaccgattttcattttgaactttctctgtatcatgttgcccaaattggtggtgcttctgccagatcaattcttttaaaaaacgttgtgggttttctataactctttctaaggttcactctgttagacaaaaactactcccacccatctttttgagataagcctttctctcccttgggctttctgtgagggggctgtgggataatgctgtgaagattcttagaatacctattatttaatgaatatgagccagtaaccatgtccttaagatgcataaaggggcttttgtttatctgaatgctgctatgtgacagtatcttaaagtatattacagtccctcctgatattcaatctttggtttgaggccctttcctaatttgagaataattcactgttgggagaaattgtggatgagaaacagtttcattttctaatccagcatgtcctgactcctttatattttcatatttaacagtttattctttaattcatctccttcctctggaattttatcataggcagcagaaagaatccaggtagtactttcaatattctgcaatagctagattattcagttcaatagatgttgtatatttcctattttccacattactgtggacattgtgaagttttctataaagggttcatttcctcttacttcccttgatattttttccacttccctttaggcccttaaaaataacatccctgaagttgaggcctttcaagctttcactagcagtcttcttaaggcccctccagcttctgctcactaactggttccaaaaccattggcacatatttgaacttttattatggcagcatctcatctctggtatcaaaatattaatacttctgttttgctaagtagcaaaccagcataaaacttggtggctttaaaatattacagtaattaattttgttcattaatttaaacattgggcaagtctctgtatagaaagatcttttctgttacacatagtatcagctgggatcactcatttggggttggagagttcacggtggctcattaataaagctggcaagttgatgctggcttaattcaacaagtaacatcacaatagcccaataattttttcatatacatatgtcataatactggtaataatagaaaacagtgatagagagcttaccttttgatagaggccacacacaactgatctcattgaatctttttttttaaatattaaaaaatgtttattgagtgcatccatcagccattcttttatggcttgtagttttcctgtcttgacaatctccttcactgaagatcaaactaaccttttaatattttcatttattttacttttttaaaaaaattttttattatactttaagttttagggtacatgtgcacaacgtgcaggtttgttacatatgtatacatgtgccatgttggtgtgctgcaaccattaactcatcatttaacattaggtatatctcctaatgctatcactccccccttcccccaccccacaacaggccccagagtgtgatgttccccttcctgtgtccatgtgttctcattgttcaattcccacctatgagtgagaacatgcggtgtttggttttttgtccttgccatagtttgctgagaatgatggtttccagcttcatccatgtccctacaaaggacatgaactcatccttttttatggctgcatagtattccatggtatatatgtgccacattttcttaatccagtctatcattgttggacatttggcttggttccaagtctttgctattgtgaatagtgccgtaataaacatacatgtgcatgtgtctttatagcagcatgatttgtaatcctttgggtatatgcccagtaatgggatggctgggtcaaatggtatttctagttctagatccctgaggaatcgccacattgacttccacaatggttgaactagtttacagtcccaccaacagtgtagaagtgttcctatttctccacatcctctccagcacctgttgtttcctgactttttaatgattgtcattctaactggtgtgagatggtatctcattgtggttttgatttgcatttctctgatggccagtgatgatgagcattttttcacgtgtcttttggctgcataaatgtcttcttttgagaagtgtctgttcatatccttcgcccactttttgatggggttgtttgtttctttcttgtaaatttgtttgagttcattatagattctggatattagccctttgtcagatgagtagattgcaaaaattttctcccattttgtaggttgcctgttcactctgatggtagtttcttttgctgtgcagaagttctttagtttaattagatcccatttgtcaattttggtttttgttgccattgcttttggtgttttagacatgaagtccttgcccatgcctatgtcctgaatggtattgcctaggttttcttctagggtttttatggttttagatctaacatttaaatctttaatccattttgaattaattttagtataaggtgtaaggaagggatccagtttcagctttctacatatggttagccagttttcccagcaccatttattaaatagggaatgctttccccatttcttgtttttgtcaggtttgtcaaagatctgatagttgtatatacgcagcattatttctgagggctgtgttctgttccattggtctatatctctgctttggtaccagtaccatgctgttttggttactgtagccttgtagtggagtttgaagtcaggtagcgtgatgcctccagctttgttcttttggcttaggattggcttggcaatgtgggcacttttttggttccatatgaattttaaagtagttttttccaattctgtgaagaaagtcattggtagcttgatggggatggcattgaatctataaattaccttgggtagtatggacattttcacgatgttgattctttctacccatgaacttggaatgttcttccatttgtttgtatcctcttttatttcattgagcagtggtttgtagttctccttgaagaggtccttcacatcccttgtaagtttgattcctaggtatttgattctctttgaagcaattgtgaatgggagttcactcatgatttggctctctgtttgtctgttattggtatataagaatgcttgtgatttttgcacactgattttgtatcctgagactttgctgaagttgcctatcagcttaaggagattttgggctgagacaatggggtgttctagatatacagtcatttcatctgcaaacaggaataatttgacttcctcttttcctaactgaataccctttatttccttctcctgcttgattgccctggccagaacttccaacactatgttgaataggagtggtgagagagggcatccctgtcttgtgccatttttcaaagggaatgcttccagtttttgcccattcagtatgatattggctgtgggtttgtcatagatagctcttattattttgagatacgtcccattaatacctaatttattgagtgtttttagcatgaagagttgttgaattttgtcgaaggccttttctgcatctattgagataattgtgtggtttttgtcttttgttctgtttatatgcgggattacgtttattgatttgcgtatgttgaaccagccttgcatcccagggatgaagcccacttgatcatggtggataagctttttgatgtgctgctggattcggtttgccagtattttattgaggatttttgcactgatgttcatcagggatactggtctaaaattctgtttttttgttgtgtctctgccaggctttggtatcaggatgatgctggcctcataaaatgagttagggaggattccctcattttctattgattggaatagtttcagaaggaatggtaccagctcctccttgtatctctggtagaatttggctgtgaatccatctggtcctggactttttttggttggtaagctattaattattgcctcaatttcagagcttgttattggtctattcttcctcatttagtcttgggagggtgtatgtgttgaggaatttatccatttcttttagattttctagtttatttgcatagaggtgtttatagtactctctgatggtagtttgtatttctgtgggatcggtgatgatatcccctttatcattttttattgcatctatttgattcttctctcttttcttctttattagtcttgctagcagtctatcaattttgttgatctttttcaaaaaaccagctcctggattcattgattttttgaagggttttttgtgtctctatttccttcggttctgttctgatcttagttattgcttgccttctgctagcttttgaatgtgtttactcttgcttctctagttcttttaattgtgatgttagggtgtcaatattagatctttcctgctttctcttgtgggcatttagtgctataaatttccctttacacactgctttgaatgtgtcccagagattctggtatgttgtgtctttgttcttgttggtttcaaagaacatctttatttctgccttcatttcgttatgtactcagtagtcattcaggagcaggttgttcagtttccatgtacttgagcggttttgagtgagtttcttagtactgagttctagtttgtttgcactatggtctgagagacagtttgttataatttctgttcttttacatttgctgaggggtgctttacttccaagtatgtggtctgttttggaataggtgtggtgtggtgctgaaaagaatgtatattctgttgatttggggtggagagttctgtagatgtctattaggtctgcttggtgcagagctgagttcaattcctgggtatccttcttaactttctgtctcgttgatctgtctaatgttgacagtgggtgttaacgtctcccattatttttgtgtgggagtctaagtctctttgtaggtcactaaggacttgctttatgaatctgatgctcctgtattgggtgcatatgtatttagcatagttagctcttcttgttgaattgatccctttaccattatgtaatggccttctttgtctctttcgatctttgttggtttaaagtctgttttatcagagactaggattgcaacccctgcctttttttgttttccatttgcttggtagatcttcctccatccctttattttgagcctatgtgtgtctctgcatgtgagatggatttcctgaatacagcacactggtgggtcttgactctttatccaatttgccagtctgtgtcttttaattggagcatttagcccatttacatttaaggttaatattgttatgtgtgaatttgatcccatcattatgacgttagctggttattttgcccattagttgatgaagtttcttcctagccatgatggtctttacaatttggcatgtttttgcagtggctggtaccggtttttcctttccatgtttagtgcttccttcaggagctcttgtagggcaggcaggcctggtggtgacaaaatctctcagcatttgcttgtctgtaaagtattttagttctccttcacttatggagcttagtttggctggatatgaaattctgggttgaaattcttttctttaagaatgttgaatattggcccccattctcttctggcttgtagagtttctaccaagagatcagctgttagactgatgggcttccctttgtgggtaacccgacctttctctctggctgcccttaacattttttccttcatttcaactttggtgaatctgacaattatgtgtcttggagttgctcttctcaaggagtatctttgtggcgttctctgtatttcctgaatttgaatgttggcctgccttgctagattggggaagttctcctggataatatcctgcagactgttttccaacttggttccattctctctgtcactttcaggtacaccaatcagacgtagatttggtcttttcacatagtcccatatttcttggaggctttgtttgtttctttttatcttttttctctaaacttctcttctcgctttatttcatttatttcatcttccatcactggtaccctttcttccagttgatcgaatcggctactaaggcttgtgcattcgtcacgtagttcttgcgctgtggttttcagctccatcaggtcctttaataacttctctgcattggttattctagttagccattcgtttaatttttttcaatgtttttaacttctttgccatgggttcgaacttcctcctttagctcggagtagtttgatcctctgaagccttcttctctcaactcgtcaaagtcattctctgtccagctttgttctgctgctggtgaggagctgcgttcctttggcggaggagaggtgctctcatttttagagtttccagtttttctgctctgttttatccccatctttgtggttttatctacctttggtctttaatgatggtgacataccaatggggttttggtgtggatatcctttctgtttgttagttttccttctaacagtcaggactctcagctgtaggtcttttggagtttgctggaggtccactccagaccctgtttacctgggtatcagcagcggaggctgcagaacagcaaatattagtgaatagcaagcaagtgctgctgcctgatcgttcctctggaagttttgtctcagaggagtacccggccgtgtgaggtgtcagtctgcccctacatgggtgtgcctcccagttaggctactcaggggtcagggacccacttgaagagggagtctgtccatttgcagatctccagctgcatgctgggagaactactactctcttcaaagctgtcagacagggacatttaagtctgcagagatttctgctgccttttgtttcactctgccctgcccccagaggtggagtctacagaggcaggcaggcatctttgagctgcagtgggctccacccacttcaagcttcctggctactttgtttacctgtcaagcctcggcaatggcggcacccctcacccagcctcactgctgccttgcagtttgatctcagactgctgtgctagcagtaagtgaggctccgtgggcataggaccctccgagccatgcatgggatataatctcctggtgtgccgtttgctaagacccttggaaaagcgcagcattagggtgggagtgacctgattttccaggtgccgtctgtcacccctttctttgactaggagagggaattccctgaccccttgcgtttccccggtgagacgatgcctcaccgtgcttcagcttacactcggtgcacagcacccactgtcctgcaccctctgtcctacactccccagtgagatgaacccggtacctcagttggaaatgcggaaatcacccgtcttctgtgtcgctcacactgggagctgtagactggagctgttcctattcggccatcttggctccaccgctcctcattgaatcttaagatctgtaaggtaggagatactcttctcagtttatatagaagaaaattgcatgttagagaggtaaataatttttctttaatcatgtaactacttagggtagagttgggatttgaaaggaaacagtttgactccagagaatgttctcttaactactgtgctaaactgctttctatttgtatgtaccacagtcttgaaccaatgccaagtgcaaattagactgtacttgctttattacaattttatgtcttgccaaaaaagataattgatttatatttctgtgttagatgtgaaatggtctcagctgacagtgaattttaactcatctttacttcataaaaaaataaaaggtatgaaataaacaagacaatttggaatgctaagaggggagtgaccagagagacgggtgaatttgggagcacagaagacaatgtcattctcatcttcctttacattcactacgagctgaaaagtatatcttaactactggttatgtgtctttaatcagcctcctggatgctgtgatggatataaagaaccaaagtctaaaatgtgagcagagatgatgtttataccaaaaataattagtttacaatttaagaccatataaatcagatgactcatgctggattagaattttcacattgccactaactagttatgtgattctgcacacatttcttaatttccctaatcttcagttttctcatgtgtaaaatagcatgtgggatatcagtaacagctagcttttatgactgaggtaagaataaaataaaattatgcacacaaatcttttaacttgaggtctggtatatggaaggcgtgaaagaaattttaagcattattattattttactgtcttcaaatacttcaatccatactctctgagaggtcagaaatgaaaacaatcaatcaatattggctttaatatgatgaaaagcttcatagaagaggtgtccttgaaaaaatgttgatagctggcattgaaaggagatattttagggtcatagaattgcatgttctcacttatttgtgagatctaaaaatcaaaataattgaactcatggagatagagagcagaggataactcatggagataggttaccagaggctgggaatggtagtgagaaggtagaggggaggtgggaatgattaatgggtaaaaaaaaaagaaatagaatgaataagacttatatttgatagtgcaacagggtgactatagttagtaaaaatttaattgtgaattttaaaataactaaatgaatataattggattgtttgtaatacaaaggataaatacttgaggggatggatacctaattttacatgaagtaattattatgcattctatgcctgtatcaaaacatctcatgtatcgcataaatatatacacatacctattatgtacctacaaaaattaaaataaaaaataaaaaaccccaaaaaggtaggagttaacatgatgtgggatgatggcattggattcttagcagtgctattctgaatgagtcttctaggccattcttgtctttgtgagagaagagcctgggctgtctttcagcaatgttgtgggtttttttttctattttaatttatacaaggggtaagttaatctattggttggagttagttgggctacttattgttttagattagtgtgggtcaggatttaatgaggtattatatgttttgttgcatactgtaaatatttctttcagcctgtttatacagttctttagaactgtttgatttacatatgcctaggtcatatatgagaaatgtatttcattaagatatttcaacatgtggcaaattagttgtatgagaaatatgatggattttctttctatctgtgagggaattcagtatactaattgttgagtccattgctgacatgagttagcctctttagtttgttcttgtctgtgtgcactttcaggttgcatattcaatggtagaaggtctgctgtgcactaagtatgtttaccagattgtataatatataataagtccattatccacacacttatggaaattggtagagcagctagtgaaccatgtctctttggtgagtacaaagacttagaatctagaaaaaaaaagtttaaagaaagttgtggcttgagatagatttgataaagaaatgaattattatacatgtacaggttattatttatttatttatttatttatttatttatttatttattttgagatggagtcttgctttgtcgcccaggctggagtgcagtggcacgatctagactcactgcaagctccgcctcccctggggttcacgccattctcctgcctcagcctcccgagtagctgggactaccggcgcccgccaccacgcccagctaattttttttgtttatttatttatttttttgtatttttagtagagacggggtttcaccgtgttagccaggatggtcttgatctcctgacctcgtgatcttcccgcctcggccccccaaagtgctgagattacaggcgtgagccaccgcacctggcccagattattttttaaaagtgtatttggcattagtttttgagctttgattcatgataaatttaatacaggtttttagtgatattgttaaaaacataagatgagagtaaaaggaaatctacttcatccattataaatattaatcttgaaatataacagtgataattttatatcattatcataatagtgatagtgaagtgacaatgaaataaaaaattatcatgtgatttttatcacattatcatagtgatgaagctctagcctgaagttgaagtattatatgtattacaaaattgtaggtagtcatatatgtcatagatgatgtatatagatgaatgtaaagtttttgtaactttaaaattttgtgagtcttagtctgtggacatttatcaacttattcagaatgtaaagtaaaatcatattcagaaatattgggtaaattctgagtaggaacaaaatctctcaaattcaaagtttataaatataaaaattttaaatatggtaaattgattattttattctaggaggaagaaaaattaattatactgctttgttttcattttgctattgtattgcctttgctacttctgataaggttttgaaaaaacaggctaatcattttggaataactttcagaaatatttgctacttctgatatttttttgaaaaaataggctatttattttgattattctatgcttagtttctagaagtaaaacgcatttaattattttgattaaagttacattggttttatcatatcactgacatattttgaaatttggcatcataaattcatcttctcaagatagaaagtagtagagcatttattgtgtcattagaaattctttctgtgaacatgtgtgtggttgtactctagctaaggtcagtcctggagaatgctactcaattctatattctgtttgttgtagttactacaaatggagagaaaagccatagccttggtttcaatccgcttttctctctaagacattaaaatccctgagaactatctagttttaaagaaataggtgattcagtagtcagtagcactaaagatatctgtccccaaatcgacttgtctgaaacgatatgaaaaagcaaactccatctggagttcaatcacacttccccatatggttaatcaccagctgcttatgaaagggagtgtggtctaggctggtaggcctgaaattagctgtgcagctgcattttggcttataggcaaaccctgtaacaagatgagaatgtatgaaggcaaagatagatatgactcctgtattcctttttattccaatgctgaaagtgctgtattaattttgatttatattaaaaagtacctaaacttgtaagaagcagtctgtattactttttcagctccaaattaaagccaaagataatcaacatgtgcctagatgtgagtaatattaacacaaatcccagaactttataactgtcacatgaaagtttctgaattttatttttgtgactcattttactctactatttctaattactctaaaatatttactctaatggatttcattggatcagaataatggattttgtttttgtatttttgttttgtttataatttacaggcaatgtcctaaacattttgaaagctaactttgagagtaggagagtggtagaattagcctactgtaaaatgcttttgaatgcctgcaggggttgggaggtggctggatgttgagattacttaatgggtacaatgtacattatttgagtgatggataccccaaagccctgactttgccagtatgcagtctatacatgtaacaaaattacacttgtatcccacaaattaatacaaataaaaataaataaacattattattagtaatgattttttagttgatgtctaattacttgaagatatttaaactttatagacctttcaaatgacaattgctgaagttatcaataatatctctcttttgaagttttaacatttctttttgagtgtcatcagtagtcttagccataaatagaaataggaggcaaaccattattccattttacccaagcagaaaattcaatttagtatctggtgtgtgttacatacagactatttggttagggatattggacctcgtttctgtccactgaagcattataggaattaatgccttcacacatttgccactgaatttcttatattacaacactgtcgcagatagttttgggtatctttctcaccttgaaacactggaccagatcctttgggggaaatctttatccaaagtggccatgggggcagtgatcatttatgtccattgggaccaataatcaaggcctacgtttgctgattgtaatggggaggtctcccccgctttaatggtaagcattacctgtaaaggaattgactgagaaatgtgatggcttttgaaataaggtttttcctatagaaatataatttaatgcaaaaagtgcacatatctttgagtgtacagctcgatgatttagacaccgatgattttaactgtggcccagtactaattgatttgtgcagtgtgcatatgagaccggagaagaaaagttacaacaaaatttaccataatggaataacatatttttaaagaggataatgtaaggatacattttggcacagtttatgtaaacataaacatgttattaaaatgccatcacatgcttgtcacactcatgcgtattgttgttaggttaaagcatttcaccaaaggatcattcctttcagttgtcaatcttcaatcataatttcatgtatatttctctcatggagaaattaagggtttttgaataatcggttctagtatttccatgtaaagtacatgacatgctatccacaaactgattttgatgtactttaacattttctggtgtgccacagtaatttcagtggtgtagacacctttgtttatttaatggaattgttttaataggatttttaaaaatgcatttctaaataatattccttaagtgaatgtgatggtaagaaactatctgtgagtgacctgtctgtctatggtattacagtggcccagcccgcttgatatgaacacataataattatatggttgacatttaatgaggtttactatatgctgtgcacatgcactaatttaatccttgaaactaccttacatggtagatgctattggcatcctccccatttcacagatgaggagacagaggttaagtgacttgcccagtgtcacttggttggtaagcagtagagctgagatttgaatctgggcattctggatctccagcctgtacttgatatttatactgtacagggtaatggatggattgaaaatgactctgtcagagactattttagtttgtgaaaatcttataaatttcctagaacaaaggtcatttactactgagcaggtgatacttcagacatatgtgtagacagaaaaaaatgcaccaaagaaaggcttagcaagatcaggcatgagacacagacagatcttttacagcactgttgtgtcatcctttcctttgccttttccagatgctgctattactgaccctgatgatgaatgattttgtcacatatccttgtgaagattaactaggatttcccagtaaacaaatgtgcccaatgacatagttagctttacacatccagcagacccagatgccacaaagttaatttatgagcatgccaggtctagtaagtcttttcttaacttcttctcccttctttctctctttgtgacaatcacacagaggcctgaagtcaaggttaacatgctgggaaaagaggattggagaatgagaagaaagtaacttactgtttccccttctccaatgcctgataacagccctggctgtgggaaggaagacaattctattttaaattaagttcagtgtattgatcagaatgtggaaaggatgccctaagttttgaattgagactgtgcttcagatctaaagtcgttatagaactttgaaagtcatgaggcctagagatttttaatctagggtcagggaagaaatatctctcacaactgaacaaatgttaaagggacacagaagtaaaaaataaagattcacttttattatatcccgtccaccacgcttgattaacttgtgtaggaagaaatcactaggaaaataaataacatcttcgattatgtaattaactagctaaaatatagagacatcagaaggaaagggagcgcagtaagcttggagatgctgagctgcatgcaaccagttaaagctggtggcttcttttttaaatcctccacttcttctgattagtatcttagatgggagtgagatcatatacatgtaaccattcaacaaattgtaaggttgatagagatgtaaattatgttttttttagtattttgtacattggattataccaatggttatctttattatatttttccatatatatttgttttctgatgcagcttttcttccctggaaggattgcatttttacacttataattgctggcttgtatttaagacataacttttttaaaaatagcttttttggaaagcttgatgaggttttcagttgtggctatttgatagtttattcataccaccaatggggagacaaaaatcatttttaatcttgttagaaaactcattaaaatagcatccatttatttttttgaactggaattttatatacccaatgacagaaaagttgatccatttaaaacaaagatcagatcacaggaggctgaaaagtttttgaagcttttgaactgccataaacttttaaattcaatatataatttttgatgtaatctaagctcctttgtgaaacaaagtggaataaacaaatagatacatatattaactacatataaaaagatggtatttctgtacattttaaatatacagaattatagtatatattttttatgggttatattaaaagaatacaccgatagactaaaaatttatatgccaaatgtttgatagtgattgggtagggttaggaggtatagtctgtcaattgggagagaaattgtactttaggaaattttcttaaaaataatgattttcttcctatttttttgtgtgttttattaataaaatcttgaataaaaaataacaaatacttaacaattcattctacatggtggaatcatgaatatttattgtactattctttaaattgatctatattgttaaacctctcaaaagagagttaaatatgttaagacagtatgaaagatagtgtataagctgtgccttccactctggaagaatttataatgcaaaagtaaacaagcctgcctgaggtgagacagatgggaggtaaataaagaccagcaaagtattttactagacggtatgcattatgacatatggaccgtgttcttatcatgaaaccccagcatattaaacagtggtagaacacaagagcatgtattgtaatagtagagtattgtgagtagcagcatgtatgtagtgtaaagtttaatagcatgttttggtctgatgtgacatcagagatacaaaaagaaatacaggcttagttgattttcatgtggcttttcaattgtcattgcaagaatataatctgttgtcatcaggtttgagaagtacataaggaactgcagttccagattgtagagacccaggagtctgtgaaagatgaaaaggacagtatgataaggttagataaataagagaactgtaaatatacctaactcccttgaaacctttgcatattcttcctgccggaaccaaagatttctacttgaccagtcaaggtagaaggaagtgtgttctattgaaaagtcttctatgaccacaacttgtactggaaacacctgtggtgatttttaaaaaatgaagattctgaccacattccaaacaaccaaatcagatgttctgaaggtttggataatgtattttaatttcttattgagaattgttgggttatggaatagtaatttgatagtagattctggcatgaaacattagaatgacagagtctaaaagtcctcattataaagctatatttcaagaagtatgaaacagaaatcctatagaattaaataaaatctgaatgattcaagaaaatgagcaggcaagcacagactgggagaaaattttgcaaaagacacatctgataaagaactgttatcagaaatatacaaaggattctgaaagcttaacaataagaaatcaaaacccaattaaaaaaatgggctaaagatctgaacagactcctcaccaaagaagatatacagatggcaaataagcatataaaaagatgcttcccattatccatcattagggaattgtgaaacaaaactgagataccaggacacatgtattagaatggccaaaatataaaactctcacaacagtaaatgctgatgaggatgtgtagcaaaaagaactctctttcatctctggtgggaatgaaaaatggtaagctattaatactttggaagatgtttgagcagtttcttagaaaactaaacattctcttatcatatgatctagcaattgcactcctttgtatttactgaaagaagttgaaaacttatatctacacaaaaacctgcacataggtgtctattgcaacctgatttataattgcaaaaacttggaagtaaccaagatattcttcagtagatgaatggataaactgtggtacaatcagacaagaaattattcagtgcttaaaagaaataagttatcaagccacgagaagacacggagaaaccttagatgcatattcctaaatgaaagaagataatctggaaaaactgcatactgtgtgattcagctatatgacataatggaaaggcagaactatgagacagtaaaaagatcagtagttgccagtggggagtgggcagagaggaggatagagagagcacagaggatttttaggacagtgaaactattatttaggatattataatggtagatacatctcattatatacttatccaaacccatagaatgtacaacaccaaaagtaaactctaatgtaaactgtgggctgtggcaataatgaggtattaatgtaggttccttgactgtaaaataaacctaccactgtcatgtgggatcttgctagtggtggagtttgtgtgtggagggggtggtgtatggaaattccttgtactttctggtcagtcttgctgtgaacataaaacttccctaaaaaacaaagtctctgataaaaactgtaatcattgattggttccttcatttatttattcattcaaaatgttaattgcatgcttattgtgtgtttagcattctgttgtcctttaggcaaatagagataagtaagctagtttaattgagggacaaatcaataggttataacacagtgtgataaacagtgcaattgaaacagaaacaaaatactttatggtcactgaaaataaagctgctaactcagttttagtcagttagttggagaagaaattaggcattgaagtatgactatgagttttccgattaaagtctttcaggcaaagccaataggggcatatgaagaactagggcaaccatgaaatatgattgatcatctctccttaatgtcattcactggaccactatcatcattctaattatggtgttataaggttatttttttgatgatgaggctctatatatgtagtttgaaaatgatactaatgattatattaacaaaaattaccgttatctagctcagagaaagagtttatattaagaagtctattaacatattgtcaatttttctcttaacaaatctgaaataagtgtttttatagttattctaattagtttacataatttagatttaattaggctagcatagattataataggacctatgcatttgtttaataaattaacattttagtcaataaattgatttttttaacagggtgtttgcttatatgagggtctctttatatcagtgattagaccagtctaacattctaatggagatgtctgtttgctttccagctaatgtgataaacaccaacagttcagcatcaacaccttaattacatacactgaaggctaatgttagacaaattgtattctgttgactactttcggttcagtggacttcagcaattgaaataagctctttaaagacaagtaaatggtgcacctgcaaagtacatgaacactattattgccatagaatttgatagaggcttttcaaaaaatcattcggtgtggcaggggctctagatttgagtaccattaacatttactgcggtatgcttggctgtgtgttaggtacttgctataatttttattctttttttactatgtattatcaataggaatctggtatttttatattatgccattttatcctgtggtttgggaagttgagcatgtatgagttcatcatcttcaaattctactcttcctacatcttcctaggcaatagctaatctatgtaatatcataaaagctattgaccagtgggaagactattttccataatgaaatatttagtacacagtacatatatgttttaaaataaattataaactaaatgatgaaacaagatataatatataaaatctaagaatttagaataagcttccaggtaataacagagaaaaaataactaatgagggctcaagagatatctaattttttttcaatccaattttaaagagagagcatctttttgtttgcaacattataaagcatcttaggcttttttaagatccactatcaaaacagtagtaaactgaaaaagctgaccatctttctttcaaagaagcttgaatgtaattgacgaatatcaccaaacattgtcaaagaaatatgttaacccattcataaaagcatatattgagtactcactatgtacctggcactgttgtatggaggtaaaggtcatgcaccccagcttcaaggacctcacaaaaatgtaagccaatcatgacaatagtagcaccaatggctcactgtacactttgaatatgccaggcttccttataaacattttgcatgtgttgtcatttcagcctcacaataatctgaatctatataaactattattaatttcactttgtggatgagaaacacaagacagagagagaatgagaacacttgcccaagattacacaactagtatgaggcatcattgagaactagactatgatctgtgccccctacaacccatgtggtttactagccttctattcatacttctcccagttttttgggttattggctttgatggagaagctcccaaagtaatgaagctatccagaagaaagataactatcttttgggggggctgtggggaagacagagtctcactctgttgcccagactggaacgcagtggcaatcatagctcactgcagccttgaactcctgggctcaagtgattatcctgcctcagccagcctagcacatgggactaaatgactacaggtgcataccaccacacctggctaattttaaatattttttgtagagacagggtcttactttgttactcaggctggtctcaaactactagcctgaagcaaacatcatatgttgtccttccaatatctgggattataggcatgaaccactgtgtcttgccagaagacatctaatttgagtcagaagaaatagcgtggaaagataaaataaattagaacataaaagaaactaagtagttcagtatggcttaggtagagttcatgagtgttgggaaaagtagagaagttggggctctattataatgactatggaaaactgtgaaagaaaagtatgaaagtaacatggttggattaccttttagataaaatagaaagggaataaactgtgaacaggtgagacaagtggcacaatccaagcaagaagagcagagggcctgagcaatgactgtacaaattaaaaaaaaaattcagatgtatttcagtggtaaacctgacaaactttgatgacatatttagtttggggtgaagggagagagaagtgtagtctaacttccaggtttctggcttggaagactgagtggaatgtgattagtaaacttggaaacaaggttagatttggtctggggagagggaacagaaggagtttaaagttgagatccattgctttgagttggctagttacgtggatccagaacaaaagactatcctggccatcattagcatattagtttaagccagagatccatatgacattaacagagaaaatcatagtacaccaaacattgggacccaagagtagaaccccacataatatgaaaattaatgagggacagaaaaatgaggaccacagcggggagtggccagaaaaggaggaaaatcaggagaaaggggtatcaaacaatttctcttgtttgagcacaatgacacacagagaagaggctgtaattcaagagccttaaatactagttttttaaatttaattctatctctaatttctctaaaactactttcccaaactgtcttgtacctattcattaaaacacctttggtctcaaattctgtgagattactcctaagtcaaactctatattataggaatgtgaacttgtgcattcacaggaggaaatactataagctcttaagtggaaaatacggttacatacagaattctgtcagcattttgcataagatactcagaagtgttctttaatgctatgcaatcatatttctaaccttttcaccagttcattgacatttctaccatcatgttaagtgcagacagaagcaagagatgggtaggaaatatctcacacatcaagggagaagaaaacaataaaaggcaaagttgggcataattttcttttggaatccacaacacctgctacatttcctgaagcctaaaacggcctctgttgcttcgactgctgctcaaaccatctgctgagtataaggaggtggtctgcagcagctgaaaacctttacaaatgcttcaagtcaggcttgttggcacggtaaggaagctagtgatgtactgatgccaaattctgttcctgtttctttccctttgctgccatgaaaaaaattaaccaaggctttaagagctgccattgacataaacatgatttaatagctctttagcatttccaggaccacagcattagcaagagccttggagatgtttaagagtagaatcttgaaattcgttctctggcaagttattttaaaaccagatgttgtaagcgtacttcagtacagctgcctattaggtgacagtacttcaaacacatagaacgtgagggaaatgtacttgctgttttctttataggatggcaactgtcacctgcctctcctaagtgtgtgagtagattttcctggttgatgcctgctctttcttctgttttccatgcttctctcaagcgtggtgatgaaagacctgtttaaagtaggagagctgtcagtatgaatcgataatctatgcaactgattatttacataattatctctttgattagagagggagcttcttacgaattaggaccaggtcttatttgggtttaaattctgattgtactttttactagtttgtaaacttggataagaaacttggctgctctgagttttggcttcctcatgtgtatctcactaggttgtgccctgcctaatgaagttagctacctttttcaaagttcctaattgggtgcctggcacaagttccaataaatgtctatcaaataaaatagttatgtaactgttataaaggattatgtttgaatttcaaatgtacataattatttctcactttatcttccactttacgttacaggcaaacaattccaattcatttatagttattgtagaagtgtttgttctagtgttcatgtgaaaatttgcattacacatttgccttgtaattgtataaagcctcttcctatcatgtatgaagcaagtccgtggttaaaatctgaagggatatgttggcttgctggtcatttttgtcagtcagtcagaaaattcagaggagttttaccttgccattcccttgaagaactggagaggttggccataatctttgttttcattttctgcctatatcccctttcctctgtcttatcaaaatgtactttttaaaaggcactgctcacatctagctctttcttagataattgacttacaaactaattcacatgttggtaaaatggctaaaaatggcttaaagcagtgctttttaaactttttttgagacttgtgagggattctatggggaagcctgatggacagatgcagggatctggagcttcaaaccagtgagactctggtactgcacccctaactctaatttcaatcgaaaaattctactttaaaaaagtttttatgtatatatacatatatatctacacatatattttattcatatattacatatatttttaagcttaattaaagaatagattttactgttttaaaaaggtgaagattatttactggcatatcatcttttagtgtcattacaatttctttttttttttcttttttttttttttattgtgagacagagtctcactctgtcaccgaggctggagtgcagtggcgtgatcttggctgactgcaacctctgcctcttgatttgaagcgatttttgtgcctcagcctcccaagtagctggggttacaggcgtgggccaccacaccctgctaatttttgtagttttagtaaattcagggcttgggtttcaccatgttggccagggtggtctcgaactcctggcctcacatgatttgcccgccttggcctcccaaagtgctgggactacggacctgagctaccatgcccagcccagtgccattacagtttcatcacaagactaaataatataactgaaaagatttctctaatcttagaatcctggctagtgataggaagtgatagtcactagggatcactgcatggtcactaagcaaatgaagcagagttaccccaaatctttctttgatagagttattatattggagataaatcatttgacatggactatttatacttctataattcatttagcgaagtgtatcatacattttcatggataaaaagaataagtataaatttagagtccttacagttaagtgaactagacatgacagaacattaactaaaggacctgatttatagatatgcattcatctggggagaaatttctattgacaacctcagggctatgcccctagtctcatcctattcactcattttagaattagtggcttgaataaaactgtaacgactgaaatctcgtcagatttgcagatggcgaagctgagagggacacagaatgtgttggatgaaagaattaagattccaaaagatcttgacaggctggaacattttaagctgatataacataatgaaatttaacagggacaaatgtgaggtcctctacttgggtcaaaaaacagaaacacaactgcagaggatgaagaaattatagcttctgggaagaatgcgtgaaaatgcttagaggtattagatgacagtcatatttttagaaatcaacaacatgatgtgaatgtgcccaaagctgatgtgggttgtggggattagtcaattaaataaatagaatctagaatgaagatggacacaggctcacctttttaaagactgcttagatttaacagtgagaatgtactgataggtaactagacaaattaaaacacatccagaaaagcctggatgtaaagagacttcaaagtcttttgtgtgaagagagttcagaccttgaactttagggaataagttctgtatgacctacagacaagaatagggtataccaagggcatcatatacaagtatttaaattgttgacatttgaaaatttctggtgtaattttggaagacgtaagattaattggtctaagttaaagatagaaagatggcatctcaatataagaaataactttttaaaatcagaactgtccaaagagggtaccgtctccaaaatgtagtttgtttttcttagtgaggatgtgagattagactgagctactattgatagagatgttgtaaatacaacattttaaaagatagcttaatgggataacttgtgatatctcttatagcctgagattttatgatcattaataaggaaattaaagacaaatgacaagcgtgtaggatgtttcaaggcagacgggttctccatttacctttcaacttggaagtaaatttataatcatctctttcaaatattagttaacaacacgctcagatagttaaagttaaaatatcaaaattaccttccctttttacttttcacattctaatttttgattctacaatagaaaaatgtgactgaattaaataattttctcagactctagacaaagccaagtgctttagaaggcacataataataaaatttcaacaaattctttcatttacaagtgtaagcaattaagtcaaataaataaaaacaaaccacaataacacagccttctataaaagtttcactttatgaactcagaataaaaggtattgaaatgcattttagtttgttttcatttatttccaaataaaatatattctgatctctttctagtttttctttgaatctgccaactaccaaggtttctatgagccttagtagttgtattggcctttaattaggttgcccagcgaaatgcatcctcctaacaaatgaaggcagtgattggttgataagccaatcaggggtcttagttgcaaacggatgaaaaagaattctcaaacttgagcatgcgtcataatcacttggaaaacttatttaaacacagattcagtaggtctagaatggaaccctatggtttaaattccttacaagtttccaggcgatgctgatgctgttggttctggaccacactttgaggatcatttattacaatatatcagagagctctcagattttctgggagttctggtggaacagatttgaggccaatactatactaagcttgaaccattgtctgttctgttgaaaccatcaagcagaatatttcgggaactatatttttctgccactactaatgataccagcgacaatgtcaactctgcattaggaattcaacttgtatccagtgatgcctccaaaatccaggtgcctccaatgctgccctcatcatgctcaggtgtgaacgaaacgtcttccatggaagacctaattggtagcgcctagatcatgtgattatgtggctgtgaggcaggctgagcattttagttctttctcctactttgagaaaacaggacttgtatttgcagaaacatatgcattaatattagaaaattccactacctaacctcattagtacatttgacagcttggtttaatttattgattctcagatttttacttttatgagacagctaaactcagggagaacaaatattttctgaaaactgccattggtgatgctgtgagaagaaagacggtgaaactacgtaagttcttctgatgtgacccgggtgagattccatgaaagcatttctaagcagttcgaaacacttttgcataccaggcattgtattgggtgcagaaatagaaggaagaataagtcatggatcttgagttaaggaaactaaggatcttgagttaagacatggatcttgcagtttcataaaggaaagagtcaaacaaatagaatgtttcagtataaatacttatttttacttacaaaaaatagattctaaggaatatattatttacataagttcatttgttcaaaatgacttgtatatacatatctacatttacatttgctctaaatgacttgtatatacatatatacatttacctatatatttacattttatctctcaattgtggacattgtgttaattagattaaacttaactcctcttttccatcttcttggaaactgtaaatatggatgtttctatttcaaattttattttttattacaggtaaatgtataaaaaaacagtgcttcaaatacaatggatatataacaagccatcaacttacttattcaaaggcaatatctaaactaagagcactattaatcatgccttagagatgatggttcaacttgacattgttttcctttgttatatcccttttctcacattattgaatcgtaacctgagcatttgctgagtagaggagcatctttataatatgaaaaatgtaatgacaagtataagacaggtagtaacggagcagagaggaggatgttgtcatttagtatggagagtgaggaatgctttctaggagcatggtgcacatgagcccacttttcaatgacaactcttaattagctaagagaaatatggggacaggaaattcatgggcagagaccttagaggtatggaatggtgtgttacatgtggagaaactattagtttgtaagaaacttgtgttatgagggtcaggagaggtgagaaggtgaaaccgaagaagtgagttgaggccacatcacagagggcctctcttgccagagtagagtgtcagcatgcactctctgtgtcactatgggtgcagcatatacagctagttgttgtccagcatcctactcttctgctgacagaggagagtagtgacccacctttctttccttccttccttccttccttccttccttccttccttccttccttccttaaggaataccatttacaaagacaaagtatacagacagaatggccatgccgctaacattctccattctgattaacgggctgtctgaagctgcctctatatattcactaatcaaactaattttttgagactacagcatgaatgtctccaaggcagtatggtacttctctacaactttttaaagttatttagaatttaaggttctaagaattaaacaaagaatataaatccactgtttctcattgtatgcattatcgatgcccctttaaaggactgtttttcatgctgaagaatatgggtttctgtaagttatgtaagtaatgagttagcctttctatacattaaaagctgatgcttttaaaattctgcccctttagcattttctgaatatgtagaagctttttgcagtggttggatttatttaaacatattatacacttattaatcatttgtgttgctgggtttaatgtagattgtttctattttggctgttcaattttaaaacacctagtttataaatggagagaccaagtgagcttgaaatggctttgtttcttcatgctgtgtaaggaagttctgtgatgccgtgcttttgccacagaggggcattactggacttctcttttgtatcaaccttctggacagcaaggaaacaaacctttagaaattcatttttcgtcacctttaaaaggaaaaacaatatattaatacagaaaatcccctcagagctactggccacttacaagctatatgtgatttttaaactagagaaatattttcctgagtagatgatctcaggcagcataatcttttacatcttcttgagacagaatcaattatttcttttctagccatatcaaatttccttatgtaaaatacttcaatatttcaggcaaaactatgacccttatttcaatagaatgctgggccaaataagactggtggaaacaatgaatctcattggccacaacggccccctgaaagagaatgcaactttcattagtgcacagtcaagttcaactatgtttggaaaatatggtctctattctcatgatgccaccctttccccaccccacccacccccacaaagtggctggcacatttacaagatgttctttttgccccctgtgcacacccacatcaggtttcagaaaagtgaaggaaaccaggcagaggcagaaaaaacacatccctaataaggtcctaggtttgcacaatgctcccaatacaactggtacaaacctcactccttatatcaaattccaggtaatggaaacgattatctagttcaatttgagtctgaatctaaatatgatcctaattaagatcatgatcacaagattcacacatgcacaatactttcaagcagagtataattaaaataacgctaaagagacagtcttctgatatttccctttagaaaaaaaaatacctacacagctatgaagagtcgttcattggaagcttctgtaaaaggaacagcagtgcaaaggtcaccacgtagtagctaagccacaagctcaaattaaaatgggcaagtgtcctatttccctctaatttagtttgggttaatcatgctttagcattttcacttcccttcttccagcctcagaattaatgagcagttgattatatattcagtatcagtttggggaagctggttaatttcatttcgtgacctcaacttaagtattatacttcaaacatatgaaaatattttcatgccaattgccattcaaaatttgtgaaaattacaatttcttcttacttcactgtgtttcttcacctcatccctgcaacctttccatcagtacttccctcttcagcattttgccaatcattttccttccaaacatttcttcccacttgtgctattcacctctgtgactcatctcctcttaaaagaagctgcaagaaacttgctcccgggctatgcaaaaccccctggcatttgttaaagccacagagaagtttatagctccctgccaccgtataggaatgtctattaatttgatcctagattgacatgggaaagcctggggcatttatggggactgttggattctagtttgatatcatgatgaacttggaaaactctttgatgattgaataagctcccaatatgcggcctgggggatcagatctctggcctgccctggggattaagaggtgagcaagggcattttaaggggttcattctccaaaatggaaaaaaaaatagaactctctcccacactgtgactccatctcaggaaatcttggacttttcaatgtctgtttctggacacatccctcagctttgagcctttatcttgtttttctgtgtctgattctcccagattcctattgcaactgtatttaccaactgctcccagatacaggcttaaacagaatctgatttccaagcccatctggatagacatatttgtagctttaccacacccccaccaccttgggattagtttatgtactcagatgcagaatctggaagccagtctgcatagtcgagattctgtgttactcttatcactttcttttgctaccaacaaacattggattttgccacctaattttcagtactctcatcttccccacttattccagtagtgttttgaacttatgatgcaagatgaagctgatatctagatttcctttcctgtctagtaccccacctcctctcctaaaccaccttcatcaaacacaggaacctgcaccaaaaactgagtgattggaatcgggaccacgttgctcattctccttcggtggctccctcctcccctcccctcctcttccctcccctctcctccccttcccttccattcctttccttccattcttcgtagaacccatagtatatctactataaagaagctaataataactaccatttacaaaatctctgccaaatgttaggaagttcatacaagctctctcatttaattatctctccaatcctgaggggtattaaaaactcttattatatagttgaagttattgagagaaggtcttgcatttagtaagtcaccaagtagtcattgaaccttggttctcttttattctaaagtccacattcttttcactttgcctcactgtcctggcactagggggagaagaagccaaaaatatgacagtctggtggtgtcaggcaagtaaacacttcaccatatgtaatgcaacctgaaaaatattctaatgaaaaagtaagtccaaagtacagaaaatgctttatgtgctttggcagatgaggaggagagtattcttgctaggccagggagtgagggagatgtagagggtgctgtcatgatgttaagttcagaggaatgatatttaagctagtccttaaacaataggataaattcacaaagcagaaactgagaaactgaagccaacatttagagtcatttgtacatttgcctgtttttctgtttttctatatcctagtatcagtcccctttttctgttgatttagtttatttttatttttattttttattatactttaagttttaaggtacatgtgcacaacgtgcaggtttgttacatatgtatacatgtgccatgttggtgtgctgcacccattaactcgtcatttacattaggtatatctcctaatgctatccctccctcctcccccaccccacaacaggccctggtgtgtgatgttccccttcctgtgtccaagtgttctcattgttcaattcccacctgtgagtgagaacatgcggtgtttggttttttgtccttgcgatagtattgctgctataaagacacatgcacatgtatgtttattgtggcattattcacaatagcaaagacttggaaccaacccaaatgtccaacaatgatagactggattaagaaaatgtggcacatatacaccatggaatactatgcagccataaaaatgatgagttcatgtcctttatagggacatggatgaagctggaaaccatcattctcattcccctttttaaaggccttgtgaatcccattcaagatatgaagtttctttccctttttatttatggccttttgtttttcctctttattctatattactgaattaacctaaggtctcaagcctgaagttatgaagctacttaaattataacatcaaattatcagagaaatagagtaggacaattattttgcattcttatttttctttccttttgtttcgtaagaatgatctatagcaccgacaacaaaaagtaaacttttaattaggtatattgtaagacatgtgaggaagggtaagattcagatggcatgtggcatgaaataattagacataaaattttcaaagtactaaaactattttagttacaaatttatctgtgataaactactaaactggatgggatgacttgaatcatgaaagattatattataattttggagtggctaaaaattatgtgattgaagtaaatggtttttgaaacaagatggagtacaataacatgaattattagggttttttttttaataatcataggactaataaaatatagactgaaagcacatgcttgttgtagaagagtctccaattatatttttaagaatcaacatatgaagtatatatagcaacctgtttaattttctcttgtattatttctcagtatattccatgaattactatcctctggatattaatagcatcttattacagatggggtccacggtggaattcaccaggttaaataaaactaaacaaatttatttaacttgctatgagaatttttagacctttgaaatggctaatgagctttataattatccgagagtttgcaatacatttagctcaaacttaactgtgcccagatctcatgtgtgtgtgtgtgtgtgtgcgtgtgtctgtgtgagacagagagaaagaaagagggagagagagagtatgaaacatcgtatgagctagtattctttggtatcccagcttaggaaatgccagtattaaaaaaaatacaaaataaagttgaaaatgagactgtttgaagaattacagttgttcaaaataagagaacacagaaagggagattcataaaacatatagttcatttaaataagactctttatttgaaacacaattagaaaatcttttcttcaatgaagtttgtcatgattatgccagcctataccaatatctcaaacatccgaattcctgtagttcaaattgtcaactttggcacttagcatattttacattatatttttagttctctttacatgtatgtatttcatcttgccaattggactatgggagcttatagaacagatgccttgtgatgagttgattgtggtaatttatatggttttcaggtcaatcacattttccagtattttgttctatcaaatcatgtgtcagacaactcattccatgtgaggtccaagaagaagggtcatttcatttacacattttggaatctgaatttctagtagagtgctttatacaaactgagactttgataattatctgtcaattgtaacttaaacatagtgataggtatttcctggcttcatgagagaaaacagaaggaatagaatagatttcagcccttggaattaactcatattaaacgataactataaggaatgtgaagccataatatggaaaattatatgtgtgtgtgaatataaagaccaggtgtgtgtgtgtgtgtgtgtgtgtgtgtgtgtgtgtgtgtgtgtatgtgaacagcaatgatcacttttgcttaatttctcgggggagggagaataaattgtttttgttttaaaagttttctacaaggctacagtaaccaatacaacatggtgctggtaccaaaacagatatacagaccaatggaacagaatggaggcctcagaaataatgccacacatctagaaccatctcatctttgacaaacctgacaaaaacaagcaatgaggaaagcattttttatttaataaatggtgctgggaaaactggctagccatatgcagaaaacagaaactggatccctttcttaaacctcatacaaaaattaacttaagatggattaaagacataagtgtaaaacccaaaaccataaaaaccctagaagaaaacctaggcaataccattcaggacataggcatgggcaaagacttaatgactaaaacaccaaaagcaatttcaacagaagccaaaatggacaaatgggatctaattaaactaaacagcttctgcacagcaaaagaaactagcatcagagcgaacaggcaacatacagaatgggaaaaaattctagcaatcttcccacctgacaaaggtctaatatccagaatctacaaggaacttaaacaaatttacaagaaaaaaacaaacaaccccatcaaaaagtgggcaatggttatgaacagacacttctcaaaataagacatttatgtggccaacaaacatatgaaaaaaagctggaacattactgatcattagagaaatgcaaatcaaaaccaccatgagataccatctcacaccagtcagaatggcgattattaaaaagtcaggaaacaatagatgctggcaaggctgtggagaaacaggaacactttcacacagttgatgggcgtgtaaattagttcaaccattttggaagacaatgtagtgattcctcaaggatctacaactagaaataccatttgacctagcaattccattaggggtatatacccaaaggaatagaaatcgttttactataaagatacatgcacacgtatgttgattgcaacaccagttacaacagcaaaggcatggaaccaacccaaatgtccatcaatgatagagtggataaagacaatgtggtacatacgcaccatggaatactatgcagccataaaaaataatgagttcatgtcctttgcagggacatggatgaagctggaagtcatcatcctcagcaaactaacacatgaacagaaaaccaaacactgcatgttctcactcttaggtgggagttgaacaatgagaacacatggacacagggaggggaacaacacgcactggggcctgttaagtggtgggggtcaaggggagggagagcattaggacaaatacctaatgcatgtgaggcttaaaacctagatgacaggttgataggcgtagcaaaccaccaaggcacatgtttacctatataacaaacctgcacattttgcacatgtatcctggaacttaaaaaataaaaaatagataaaaaagaaagaaaacaagacacacatggaattcttgactccatgaaaaacacagtgtaacagagaagactaatttaaatgagtatttaattaaaatttatgtaatgaaacataattccgtctgaacatatatctgggatatcaggaggagatactcttaggaaatgttttttagttggaaatctaaaggatgagtaagatttagttaacctgagacttggtgtactcagtttggggtatgttgggtaaaaattgccttcaagacaaccaggaaggtaagttgagtaggcattggaacacatacggctaggttttgtttataagtggagcacaggctggagttatactctcagaaaatagtctgtaatttaaggcatgagattacaaagaaacttacagagagagagagagagaaagaccatagagggaccaatatggtagtctggaatttagccccaagagtttgaacaagaaatggggttatatttttaggaataaagcagattttagaatagccagtgtggatttatttatagaagtacttcacagagcttcaatttctatggtattattttaaaacattttatgggggaaatgttttaaaatctccttttagctatttaatttatattacttagctacctaggatttgagatgtgtagttacctttccacagatgtggtacctgtaagtctcatacagatcatgaccttggacagaggcacagtgaattcctccaaggtcatctagcttgtggtttcagcttaattgcaactggggcaaataacttgtgtaactgcccatttctcatccaccttggggtattttgaatattttttctaaacaattgtaaaccctaaagtttagctgaatttttgctgtattattatcttttctgtgcttttctgagttgttaattatattgggagtgttcagggttaacttacctttaatttctatattgtggtaaccttcagaagaagaactcacagcactgcacccactttgcctcaattatctggttctatacctgcacttgtaactaatcctctcattctattctccagctttcagatgcttgttattctcttcccaactgcagtttccttatgaatccctttgccttgaaattttccaaaactgcttaacaggagtgccgtatttagcttctaaatacgtctaattctcctatacaagattgttctcttttcacttggcgtcaagggattgactgaaaataactatccttttgttacaaagaaagaagagcaaaactaaagaaattcactaaaatggaggcttcacaattattttaaaaagaaaagtcataaaatgtctgaacaccagtagcttccaaggatggcagttttgaggccctctatttgctttttgggaattccattttgaagaattgatttgatttatgatgtcacattgtgtgagaagggagagaggttgagtactagtctccaaatttagattgaagtcatagagactaaaactattgtaaggcttatttttagtatacactattatatagctttttcttcagtactttgtgtcaacaatgtagcatttatcatgtattttgattcttattcaactatcttgtcccctttactagatttgaaatatcctttttttatggcaacctgtgttcatttgtctttctagtggactaagggtcctttaaaaagtaatctactgaatgaataaatactaattacagaacaggaaacctcagtttttgctttcaaaatcagaacaaattccggtaattatgacaaagagatctcgaaaagtaagcaatatagattttctaagcatgccttttcactggatgaaaaatgaccttttagttaaccacgcctcctctaccagcgaagggactcccgaaattgcaatatgaattattgatttggaatatttccttcctggcattataagagaatgctgccaattatgaggaacatcatagtggctagtatttatgagcgcttactatggcttaatgcctgaatggtagtagaaactcaataaatatttgttgaaagaataaatacaaagtggtttattaagtcatttgtacacataatctcatttaagtatcataataactttgcaaaaatagttacaatacaatttttattcacatttctcacaataaataaagctcagaaagattaagtatattgcccaggatcacactgctggtatgtgacagaaacatctccataaactatgtggagtgactctttccacagaatcatagaacctggcaaaaccttgcataaagggagattattacttatgaaatgcctttttagttaggaatccagaagaattaaaataagtcctttgctccacgttactccaattctatcctggccttttaaaagggaagcaaatcaggtgatttgttgttcaattttactgggaacaaaatcaaacaactagggagaaaaccagagaagaaactaaagctatggaatcaaatcagactgagagcatgataggaagtgtaatatatctctctgttccactttatctacaatgaaaacagtaaagaacctgtcagctaaatcatgaatattatttccgtcatgactaacctgtagaatcggtccaattcttttatttgattaggtcataagctacatgctgtgaccgacggcaggtagagagtttattacactttcacgttgttcttgtttctataaatatgttagttcctctgaagaagcactggacttgttattctggcctaatcattttagaccattattttccaaaaggatctggggttttacaaaggtgatttcctgcagttttgtttgtttgttttaagtttttttgcaccacttaatattgcttacatttttaaaattatgttgttgtttttttttgtagaaggagtcttgctctgttgcccaggctggagtgatctcggctcactgcaagcttcgcctcccgggttcacgccattctcttgcctcagcctctcgagcagctgggactacaggtgcctgccaccatgcctggctagttttttgtatttttagtagagacagggtttcaccatgttagctaggatggtctcgatctcctaacctcgtgatccacctgctctggcctcccaaagtgctaggattacaggcgtgagccaccgcactatgtgtttttttatgtgtaggtgatctcaatatctcatagatatttaattcaacatttgccattgcattactagacataaaatatttcatttaacacccaattcttccaattgattgatgaaaataaatccataatcaaaagaatttgataaaaaataattacttgacagttattattttttttcccaattaacaaaaagagagataaaaattggagccacacagacactaaattattttaattttaatgttgcatatttatactacaaatttttaatttgtgattcattaaaagttattagttatggctatcactttgcattgcagaaactttgaaagtaggaaaatgtcttagaagtcatttattccaacttaaaaattttatagacaaatcataaaaggcaaatgctaaaaatcacacagataaaaaccagcataacaagatttgaagctgggtctttggatgactgtttggcgttcccaagaccattaattttttaatagtttacacatgtattatcagtaattcgattaagaaaatagaggcatgactcttaaatttctctgtgtcgttctgtagtaaaagaagtaagtgagagcatcatcaagtaaccaggtaggaaactgtaagtatagagttgcccgtctagtgtggctgtgaagagatatttatggagttgctaccgtatgctacatttctaccatgtcccataatgtcactataaagcaagcaccacataatcgcacaagcagccacggggttccagtcagtctctgttattgttagctttccaatgagacaacaaataggtctttgaaaagctattccaaataggtaatatgggtggctacaggaaaagccacaggatgttatcctgcacacaccaagactgacatgaaatcagggaaatcagaaaattggagaactctggccaggtgcagtggctaacgcctgtaatcccagcactttgggaggtcaaggcaggcagatcacctgaggtcaggagttcaagaccagcctggccaatatggtaaaaccccatctctacgaaaaatacaaaaattagctgggcatgatggtgggcagtagtcccagctacttgggaggctgagaattgcgtgaccccagaaggtggaggttgaagtgagctgagatgatggtgccactgcactccagtctagcccagatgacagagcgagactctgtcaaagaaaacaaacaaacaaacaaaaaacctatatagtgctttgcagaagtaagaaggggagaagtcaaatcaattatctctgaaaaagaactttcagaagagcataaatgcattattatttggaaaaaacaaaaacgaaataagtgaattaaacctggaataggttatcataaatataagatgaatttaggatttggataggccagggaattttcaaagttactgagcaagttgtactgtggtttggctgctttttggttgtggatgtccataaatgatgttttcattctcagtatgccttattagtgcttagagcaatagctcctgagaggttcatattttgactctagtttttgggactggcgtagtgatacatcaccttagagactggaatcccttctgagaaatgcatcattaggtgatgtcatcattgtgcaaacaccatagagtgtacttacacaaacagagatggtatagcctactacacacctagctatatggtatagcctatagctcctaggctacaactctgtaccgtatgttattatactgaatactataggcaattataacacaatggcaagtatttttgtttttaaacatatctaaacataaaaaggtatggtaaaaatatggtgtaaaagataaaaaatggtgcacctacacagggtatttaccatgaatagagtctgcaggattgaaggttgctctggataaatcagtgagtgagtggtgagtgaatgtgaaggcccaggacagtacagtaaactactgtagactttataaacactgtgcacttaggctacaataaatttatcaaatatttcttcaataataagttaagcttagcttactgtaacttttttcctttatacactttttaaaatttttgacttcttacaacacttagcttaaaataaaatacattttaagccatacaaaagtattttctttctttataccctttttctgtcagttttttcaattttaacaattttccattttttacttttcaaactttttttgctgaaaattaagacacaaacacacacttagcctaggcctacacagggtcaggatcatcaatatcaccgtctcctacctccacatcttgtcccaggggaaggtcttcaggggcaataacacacatggagctgtcacctcctatgacagcactgcttccttctggaatacctcctgaaggacctggcctgaggctgttttacagttaactttgtttatcataagtagaaggagtaaactgtaaaataagaatacgatttatagtataataaatacataaaccagcagcacagttatttactatcattttcaagtattatatactgtacataattatatgtctgccgtatctatgtatgtgcagtttatcatggactgcagcatcgttgtatggtgcatgactgtatattcattcaggaaatatatattgagcactatttaggtcttttgaactatgctaattggagtgggtacaaaactatataaaacaggatttctgcctttaagaaaattatggtttaatggggagactctcaagtgactcaacaaagatggtggtaggaaataagtattatgctacagtatgatcgagtatagacaagatttcctggcaaaggtaattctgaaagtgagttttgaagtacaagcaggagttagctaagcagaagaggagaaaaggcattactggccgaggaaacagagcacgtaaagagaaaaaatataaaaagcttttgtggaattctaagcagtactgtataactgtgcatatcattaatttatttaataaatatttgttgaatagttatgtgcctggtaaattttaggctcttagatatgaccgtgtttgagatagatacatttcctgctgatattctagtgtacgtaaaggggcatgtgatgaacaaatgtatgttagaggtaacagctaggatgacaaaaacaaggcagagaaaggggaatagaaagaatcagggcatggggaaagtggggtgaactgctatgtcatatgaagtggtcaggaagccctcttccataaagtaacattatctaagagtagacacataagaaaagtaagaaagatagcaaatatttagagaaagagcctcttaggcccagagaagaacaagtgcaatggcccagagacagaactgtgctcggtgcatttgataaacatcaaggaagccaggggatctagagttgaatgagtgaggaggtgatgaaggaaaagctgagtaagaaaagagtggtagaaagtgaggtgagagggagaccaggtgggccaggccacatagtgccacacaatcaatttttgggattttggctttttactctgagtggtgtgtaagtccatcagaaggttttaagcaaaagagcatcatgatatgaattatgatcattctggcagctatgttgagaatagcccatagggacagagtagaaacagagagtccacatagtaagcttctcgataattcaagggagggatgatggtgtgcgtggggtgaaggggtaagccttggtgatactgagaagtggttggattctgtgtatattttgaagatagagccaacaggatctcctgatagactgggtatgcggcaagagaagaaaagaaaagtcaagagcaatcccagtattttggcttgaacaattggagaaataatgaagctgtttactagaatgggaaagacaataggaggaacagatgtgagcaggaggagatggtacaaagaaatcaagtaatttgttgggagattctatttttgagatgactattaggaatccaagtggaaattgagttaccactgaatatttcagtctgaaatttaggaaagacaggagatttgaatttataactcatcagcctatagatggtacttatgtctataggacgcagtcatatgaaaggcagtatggtattccatgttctggagccaggttcgttctgcacattacctgtgcaaccttgggcaattaacttatctgtgtttcattttcctcatttacaaaagaagaatgacaataatcataaggtgattgggaagtttaaattgtcacttataaagcacttaaaaagcattgactgacacaaaataagtcttcaaaaatattagatatatttataacaatgtgggaattatgtcatgagatgtgtatattggggcaatatttttaaattatcaaaatgatttgtctataattcttcttaaataataggaccttgcaccttccccatgcaatgtattaagagcatgatgcctaaaaccatcattgtttagctaagaggtttaaaactgcttttcttatgtttcttgtgacaccgtagccttgtaaactaagttttggtaaaagaaaaaagggaattctacattccaaaagcttccctttataaattaaaataaaatttcagaaggcctgaaaacagaattatactataagccattttcaaagaaaaaataggattaaatggattaagtaggaataactgccttactttagcagatctacagtgccaggcagaggtaaggtgaacacctagtcaacagggaaggtagtagacagctttgggagcagtcatctggcctggcccatgctaagatcaaggctgatgatttataccagctgcagacactcttgtggatactggaggaacagacattaacatccaaatactagctaaagtggagcagcaaaggagacagttccatgatcaaaaacacttatccccattccatgggtagatctgctcccttcattcaagcactatatcaagaatgtgaattataaattatcttaatacttccatggaagagactgatttaaattgaattacactaacttgttaaattttaagatttgttttttaagtactaggaagggaagtgcaaaagcagagcaaagcttttattgacaagaacattatatttttgttatgtcataattgtactgtgtatatatatttattatactttgctagacaaggcaaggagaataagggacatgtctacaaagataattttagactattttctgagccattaaaataagctatttggggaagatacttcagattgcagcctggggaaatattagagaaagaagttgatgttagagacaaggaggcaaccagaagttacacttgtatcaattttttaaaactcctatgatgttataatcactgatatatggctggtataagtttatatacaaataaatacttaattttccagtctcctttgaagttagggggctatgagtgttgatagcagaagtagcatgcttgatttatattcttaaagggaggacttgctgcttttcctcctttttccttcctggaaaatagatgatggctggagctctgacaaccatgttgggctataagatgaccttgggagaatgaagccatgcattcctgagttaaaagataggataaaacctaggtgccttacattttagagtgctctaacatcccttgatgactacctctaactttttgaatataagacagtgatttctatattgttttactcagtcttgagtgttttttttttctgttccctattgagcatcctaataataaaaatacttattgaacaacatttagcaaacacgaagaagctatttatatatattatatataatttatatattatatataaaataaaatataaagtatgcatatttccaccataaagaattatttattattaatatttccaagttttctaaagacttaattttagtttttttccctaaacttttatatatagaatgtttttaaccgttgacatggacgatttgttttaacagtggtgggattgtcattatgctgctcaccaagtatttctaactctctgcctcctgagctcatggtagggttgtacttactcacattctgtgattgggtgggactgttgtccagttctggctgatgaaccgtcagccgaagtggcttgtgctgctttttgtctaaaattgaattgccagtttttgagtcattttcagagctctctttgctgtctgccacagagacctacaaggtagtcccagagttacagctttgagagtctagatcacaaagtgatcagggtcaagaaataaacatttgtacctcgaagccactgagatttggggccttgtttgttattcagcataaactagcatatcttgactgatagaacaattaggatatatgatagtctatagtatgtgtgaggtgttaggataaattctaagatcctcatccgtatttcacacaactgtcctcattgcttgatgaattccagtccgttggttcctcacttgctccatgctctttcctaaatcattgctctcaagcatactattgacttgttcagtaacataccaagcgatctttgacatttccattaagatgtcatttacttaccaaacctttccctgacccctaggcctttgatagtctcttttgatatgaatacttctacttagaaattaccactatactaattaaattcttaattatgtaattaagaatttaaatctttatcttacactaaaatgtaaactttataagggttaggacaatacatttttgcctacttctttatacatagtttctaaggcagatacaagtattacagcataaaacaagatatttttcatcctaagcgacgttcacagagcatttctccttttgagaaagactctgtctcttctttttctttctttcagatttctaaattataatatcccttttatttgaagtaaagttgccctgtaggaaaagctgaacttattcagtctggaaaaaataagcatgatatactggggaaagaggatattacaatttatgtgaagaaaaatgatgataaactggtgctagtcctgtgatattatttttatggataggtactgaaaatgagatattgttgcttttggaaaccaaggatggtttgcttttaaagaggaaccaataaaggtttagagtaaatgaaaacccgaatcacaaaaatagtactgaaatcttagattaaagaacactttattattttatatgttctacagttgcaatctccaaatcttgtgagaagagtttcatttttagaagccataatctgaattttaaaatatcaccaatactgcaaaatacagaaaatttatcctagctttataaatctctgttggataatgggtggtttccaatgctttcaaagttttaaaaaatatatttccagtttcaagacagaggacagtatcgtaacaactggcatgcctacctagtgacttctgttttaatttcattggccaatttggttaaatacatatgcctaactccaagggtagcatggagctgaatatttttagatgcatactttgccttatagaataaaattgagattgtaaggaatgggaaaatggttattgggcaagtaattatgtatgttttctacaatacattttaataattatcagtaagaataacaaacattatctgttataaatgacttattgtttctaaaaccattcaatctgtgcaacagcgaattaaggagacactattgctattaactctttttattgatgaggaagcaagatggacagaacgattaggtaatttgccttagatcacacagctggtcgttgctgcagtcatgccagtgtttgaacctaggaatctgactcctgacagtgcttttaacccactctattaacaaagtttaaaagtgtgtgattacatcttagcacaagcatgtacatttgcctgctttagtgctaaagattaagcttcaattagtgtcaagttttgaagatattgggaaaagccattatgtctttttatgtataatagttcttaactatcttaaaccatttaaattatttttaaaaacttattttaagtaaaaaattaataaaatacaaatgcacatggtataaaattgaaaatatcataggtcatatacacagaacaaaatgagtacaatgaaaagtaggtttttctcttactctaaaccctgagtctctggtctaccttgaggagaggtaatcactcacatgtcaaagactgtcattgtcccccagtatccaaactttcttttttcctttcagtaactgaccatgtaatttttatctggcttacatgaacgattgtctcagcagtaccctttccagccttccttgtagctagatgtagacatctgtgaaatcccagccaatgaaatattagtgatgtgatgtgtgcaaattccaactcatactctttaaaaaggaacatgacttacattctgttttctctttttctctttctgtgggctataaagtggctgaagtggctggtggtggtccacctaaattattcaggcaatggcagagaaaagggaatttttcttggagtagagaagaattcacccatctcctctccacatcttcaccctgaacgatttttcagcagagaaactaatttctgctgtttgaattaatgtatggattaagttgatgtaacaaagagtcacaaaaataaatgttaacatttcttttgtcttcaatttcctaaaattatttctcagttcatttgaaaactacaatgataatatgtaaattatgtttgggcttcataaaaatctttgtatttcctaagctttaaatttccaccaagaaaccctgttaatcaattttctcatgtgttaatgctctgtcaagagatacggtttattttacttgttctcctctcaaaaatcgaatgtgaagaagtaaaaattaatgtttcttttctggctgaaagtctgcctttgtttttagagtggatataatgtggactctgaataaggattggactgtgctttttaaatatcttcgtgcaaggaataatcaaaagctctgatgttatctaagcaaagagcaaattggctttgtgtggcatgtgtgtatatgacttcatagatacttcagtataatattaagtgaccaaaacaatttaaatgcctcccagactgagatcttgtttcttcatattctcatcagttttattaatatggctatgaagattatttttcagtttaaaggagtgaagctcctttaaaaacagcaaactgaattggttgtatccatatttgcaactaaactcacttccaagccagttggtcctgatttctattttcctactgtctatgctcagagaatgcaagcattcactcttaatgatctctgagatcctgcagcaactccatatggaaatgaggaggaaataaaaaacagggatcaaaatatgttcaatgtattttatacactattttattttctttttatctctatttctgtacagcctttgttatatgagttggtgactattttcatagtggttgcaattgttttttatatgcacccaaacatctagaaaagagaaaagtggttcaaggtcagtgcaggtgtatgaaggctaattattagagaaactataaggaacacaagaacctaaaggcacatagctattttattttgctgcaaaggataaaaatctttttgtttctcaagtatagtgtttcttctgtttgtaatttactaaaatttattggcaagattgatacaaggaagtaggttttaaactcttttcatttgtctatgggctcatatttattagagaggaaaatatgtatatttgagaggaaactgtgtatatttgatgggcaaaacaacaaatatttcataggttcagaatgtgctgtacagagctgagtcatttttatatccgctgatactattggtagttcaatatataaagctgaagaagggataccagtcatattgaagcttttgaagatgtcagtctcaaattttgaagagttattgtaaacatgtatttaaaaaatgaaatattgaaagagatttccattgtctttccccatatattttgactgaaagtatgtacatttctgggtaagcttttagttgttttatgacttttccccctcctgttgccatagaggggctgtgaactcattacttataaatttagcctccacctggtttccactaaagtcagaaggctagcatcttcactcagaggtttaagtgcacacggtagggcgtagttgacctactgccttcaccatctccatctgcttctctttgcctccatcccccatggccactgccaccaatgcctgccatgtcttccagcatctcttagagcttttaagtgagttcaagagagccatctgtctgtgaaccaaaagttagcaatagtgcacattagtgagtgatcattttgaaaaccaccaaatgacctgtggttttggtgtttttaaataattctgtatgtggtctttagtagttatctcttagcagtattgataagcatttacttctctctctgttttgtttttctttctattcttgcatactgttatgttcttctcttgttttgtaattttatctgtcctgtatttgtaactgtagtgcctccatttatcagtgtttctcagtgggggttctgttggcaattcaggtaagacaatgctttatagtgcagaatgttgtttgttttttggcatttagcaaccctggttcccaaccactaaaatgctgtagcacttcctagctactgtgaaaagcaaaaacatttctttatagtgccaatacctcctaagaaggcagtatcggcctttgttaagagccacagatagtctgaaattccacagggacactcgtggggggatatgtttatttctattaatcaagtattaatgtttactttgtgactagcactgtgccaaatgaaaaaacatatcaaagttaagacatgcattcaaggcaattaatgaacaacttgaggctccaacattatccacactgtaattaatgaatagatagtttttttttttaattgtctgcaagtgtaatctattgggtaaagagaaagaaattcagtcctatcttatgacctcctggcaaatcaacaatgtcattatctttttatgcaacccaaactctccttgggtgtctcagaaaagggattctgtctttcaaatctgctccattcccaggtagtgttgggacagatagtaaaagggagtcttattttgtcatcatggcagaggagaaatcataccattcttcagatacattttgcagttgtggtctgcttttgggagtggtgccttctgcgctgcaactggctgtttctagctctctggataaagctgcactcttccttgtggagtctagggctctggcatcattggtctttgagcttgaaatcttcagtggagataggctctttgctttagatccagggatttttcataaagcttccttttatttcccctaatttgcaaagacttcttggtctctcacacataggccatggaaagccagaaggacagctttagcttcacctgcgtatgtatcttgaaacactaccatctcagccatgaagcccaggtgctgagttgaaaatgtcattgtgcaagcttctaaaggcttgctttctccttgctactatgccactacctagatgtgcttggccacccctctacttatccagcagtttctaaaattactcatctcccacacctggtccccaaatccctgggattgcaaggggtgggaatttccttctttcctcttcctctctggaccactcatataaactgtgaagtgtatcaaagtccacttcaatactaccaagttttcaggcccattttttctgcaaaatcttattttgagtaaggaaagctaagtataaattagtctatttttatccctcttaatgattttaataagccattcatagacaggtggctatatttggctttcagggtaaaaacttgtatacagggaaatacatatatatgaaagtgtatatagggaaatgtatatagaaaagaatacactgattttattttattattagcaccacataacagccatgtctatacataattatatgtacacagtgaacaagatcaggtgacatttgcttgtgttatctagggatgctgtggagcatgtgagattgaattaaatttgacacatagatatggtatgaatataaatagaaaggagagaggagaggtagcacaatgagcatagtgtatgtatattgaggagttctgataatatagttttaaacaatcatttacataaagagatatgaaggcacaaaactaagcattacagggcctcatcttattatctcttcaaaatgtcataaataatctttacaaacatgtaaaaaataagaaaaacaagatgttaaattgagaaagactttctctctctggtagtggtttattttactattgtttaaaaaacttattttccaattattcagtgattgattttattatctgctagtgtttaatagaggaaatgtggcagcaggtgccaaaaggttgttttttttttttttagggggaagaagttaaaattggaaaaaaaattttcattttccccttgcaaattggaaaaaagatcatttttattcagtgttaaaagcagaaagcctctttggagcttgggaaatactaaagtttccggagaatagattgaaagccaccacacgctgtaaagtctattctcaacaatcgcttattttaaatctaataacattgtttattttttctttttctttccacttaatttggttggagtcatgtagaacaacatttatcctttgatttaaatgtaaattgtgatctaggaaatacattttgcccaagaattttatatatatatatatttttatttttatttatactctgaaaatgttatatactaaaagtattatatatttaaaagtattacaggttcaagactcaatattcaatatttttactcattaactcattaacgtttaagtggatcatgttaatggatttgtgtggcaggcagaataatatcttccccaaaagatccatgttctactccccagaacctgtgtatatgttatgttgcgtgggaaggagaggattgaggttactaatcagctgacattaaaatggagagtttatcctgaattatatgtgtggttccaatgcaatcacaaaggttcttaagagtgaaggaaggagacagaagagtcagaatcagagtgctgttatgtgagaaagacatgaccaacagttgcttgctttgaagtggaagacagccacaagccaagcaaggtatgcagcctgcagaacccagaaagtcaagaaaacagattctcccctgaagtctgctgaaaagaatgcagttctgccaacaccttgattttagacagatctatcccacatagatctcactgggaagaactgtaaaatgataaatttgtgtaatttcaagccaagaaatgtttaatatttgttatagcggcaatggcaactaatatagcgttactaaagtgaaaacatttgagttgagtaggtatctaaaattgagtttcagttcttctttttaattaactttcagcaaattattaaagttattaaacatctacaataaaaagaatgattattaactttcaggatataaaagtaaagaaaataatatacactttaaaaatctgaaccatatgttaaacactgtgtgctaaaaattatataaacatttgaaatcaaaattattaagaataaaacaaagttctggtttttaaggaatttgtattcaaatttagaagaaagacatttaaatgaacaaatttaagtagaaattaagtagaagatgatattattatagagaaaatagcaaattattggagagtgttaaaagacgtgccaaaaatatttggagatgttatatctaggatgaattttgaaagatgaatacattttgccaggtgaatattaatgtaaatatacttagaattttattcactattgacgagggtttttgtttcggcagatttttttttgataaagttaaggaaatatttatttattcccatgcttaaaatattttttaaatcaggaatagttttgaattttatgaaacacatttttggtctctgtgggaataaagattgttttaccttctagcattgcaattctggggaaagtcagtggaatttacaagttatatattgccaagttctgcttgctaaattttttttttttaaacaacatgattgaggtatatttttcctttggtaaaatgggtgttttttgtaattttgattaatctagtgaggaaagaaccagctttttgtgtcataattttttttattggttttccattttttatttcattagtctcagttctgatctttactttttccccacttctacttattaatgtttaatttgctcttcattttctagtttcttacgatggacacttagataatttagtttagatatttttttcttctaatacacacatttaaagtcataagtaagccagatgtggttccagctatgcaggaggctgaggtgggaggatgttttcacttcaggagttagatgcttcagtgatccatgatcatgccaatgcactgcagcctgggaaacagagggagaccctgtctcaataaataaataaatagacaaacgaataaataaatattctaaatactgctttagctgcatctcacagattttgatatctcacattttatcattcaattgaaaatatttctaaatttcacttatgatttctttgttaacccaatggttattgtcaagtgtgttgtttaatttagaaacactgagaatttctcaagtaattttttgatgtttatttatttaaaaaattacacctagtaaaatttactcttttggtgtacagttctatgtgtttttccaaatgctaggtaccttgtagctactaccgtcaaactatagaacagttctattaccttcctaaaatttatatttgtgtgtgctttgtagtcagtatctccctgcactcttgttctctgtctatgtagattttgctttttgagacttcaaaatgaattatgtgtttgttctctattaggtactgtctttttactttctcttaagactgttgttaccaagatgaacaaatacctttactgcagctgcagtttcagtatcaggttaatatcctgatattaatattgttaatattctggtattattaattttatctttgttttatccctttgcttaagagctaagctccaagttaatttttttccaatattttagccaatacttcaaattattttagaatgagagtcttttgggatatctgccctgatatatatctaaaggcagaaatccaggtcaaaattttttctccaaacttaggttaatatatacatctgcagataatatgccaaacagttgtcatacaaatgagcttgtccaaaagtttcttactcaacactggttttgagatcaattcattgtgtgtgtatgtgtagtttctgtttatttaaaaaataatttatgatattcaatcatacatataagtcttattttccttctttctctgaagggcaaaactctctcaaactgtgttttcctctgctctcacacaacacaacaatcatcattacagaaggagaattctatggccaaatatgtggggatttttcctcacataccaagcagcagacaccagttgggtgccctccaattcaattcagatactttacctagagatagtgtcagatcccacaggtttaaggctcagtccccaagacggacccattaccccagataccagtcgcaagtctgggcccctgaaacttccgattgaccaacttcagtttgtggtttctgtgaccttctctttgggtttgattaatttgctggagcagctcacagaactcagggaaaaacttatttttgccagtttattagaaaggatagtacaaagactacagataaagagatgcataaggtaaggtatggcggaaggtgcagggagcttccatgccctccctgggtatgctatcctccaggaatctggaggaatcacacggtcagttttctggaatcgccgaactctgtcctttgggtctttatggagacttaattggttcactgaaacatggacaattgcatcaaaatgtaattggatgaaaagggtatgatctaaacccagcaagtcgtgtctgttaggtccttcttagtctttgtgcaacatatcttcttccagagtatggggcaggaccctctctggaatgagggtcttatgacccacaatcagattaaagtcctgacatgggcaggtaaaagaaggacaggagagggtcagagagagagattttgtttcctgaggtcgcttctaaggcccaaattgccccaacattataacaaaatactgtaacaatggttatgagagttatgagctacgaactgtgaatgaaaaaatatatatatattcatatatatgcctatatatattagatatcatactttctctattgaggaaaatttagactatttccttataaaacaccacaatttttaataaatgtatttattagaatttatgtaagtatatagggaaaatagtaggggaaatactatattacatggtatatgccttttggttgttccaaactgtcctcctgagccactgaaccaaactgcattatcactggcagtttatgagagtaactgatttgtcacaccctcaagaacattgatagtgtctgtgggacagattctatttttcaaagatggctgcaacatatctctgaccccatatgcttttcttacaatgtactttaacagtcctccattaagagctatgcttggctgggcatgttggctcatgcctgtaatcccagcactttgaaaggccaaggcaggcagatcacctgagatcaggagatcaagtccagcctcgccaacatgatatatagctcaggctatcaccttatagatagcatatttcttagatggtgtctaaactctcaatacttctccagaaagttcataaaaaagaaccctaccatgggggaatccatagaaaagaaaggagggagagctatcaacaccacacttctgagttgtatcagccagcttctcaataatctcccagaaatccaggcacccaaccgtaggtgggctgtttttctccaagtctgaaagtgaaaggtggccccacataggtgggcatcaaatgataaagaagaaagcagtcctgctacagaaaatttttgtctcaatactttagtattatttgttagtttcttctttcctttacaaacttgatgcaaattgcatgagatttgtctatcttattaatcatttcaaagaacaattttatggactgaatgtttgtgtctcactaaaattcatatgttgagatctaatctctagtgcaatggtattaggaggtggggccttcaagatgtaattaggagtaggagaggtcataaaggtggagtcctcatgaataaaattaatgcctataagagtcacatgacagtgctttcattctctgccctactctccaccatgtgatgatacaatgagacactggccgtctgcaacttagaagaaggccctcacaagagcccaaccatgctgccaaactaatgttgaatttccacccttcagaactgtaagaaatacatttctgctgtttataagctacccaatttgtggtattttgttatagcagcccaagccaactaagacaggtttcattaaaactttaacaatttctcttttctttgttttttattatatttttcttttcttattcttatttaactctatgattcttttcctggttgtgtgagtcgaatatataactgatgtattttaaaaatcatgttgctattgaagaaatttatttaagattataaatgttaatataattacaggtatacctctagatattgtgggtttggtttcaaactataatgatgaagtaaatataaaaataaagcaagtcacacaaatttttggtttcccagtacatataaaagttttgtttatacttatgtagtctatcagatgtgaaaaaataatgtacctatcttaattaaaatgttttattgctaaaaatgctaacaatcgtctaaggcttcagcctgtcataaacttttgctggtggagggttgcctccatgttcatggctgctgactgatcagggtgatgcttgctgaaggttggggtggctgtgggaatttcttaaaataacaatgaaatttgccccattgattgacttcttctttcaggaaagatttctctgcagtatgtgatgctgttggatagcatcttacccaaagtagaacttctttcaaaagtaaagacaatccactgaaatgctgtcactgccttatctactgagtttatgtaatattctaaatctgttgttgtaatcttaacaatgttcaaagcatctttacaagcagtaaatttcatctcaagaaagcactttgttttttgcttattcataagaagcaactcctcatctgttcaagcttgtcatgagattgcagcaattcagtcacatcttcagtctccacttctagttctcttactgttttcaccacatctgcagttactttctccatcgaaatcttgaacctctcaaagacatccatgagggttgaaatcagcttcttcaactctcctgttaatgttgatattttgacctcctcccgtgaatcatgaatgttcttaatgacatcaagatggtgaatactttctggaaggtttttaatttacgatgcccagatccatcatgggaataacaacctatgacagctatagccttacaaaaaaatttcttaaataataattcttaaaaaatataaatttctccttaatccacgggcttctgaatggatgctgtgttgataaacataacaacatttatctccttgtacatctccatcagagatcttaggtgaccattaccattaatgagcagtaatgttttgatggaaatcttttttttttttccctgaggagtaggcctcaataataaagaaaactgagtaaaatattcagtaaaccatgctataagcagacatgttgtcatccaggctttattgttccatttatagagcacaggcagagtaaatacagcataatgcttaagggctctagggttttcagaatggtaaattaacattggctccaacttaaagtcaccagttgcattagtccctaacaagagagtcagcctgttctttgaagctttgaagccagacgttgacctctcctctcttgctagaaagccctagataacatcttcttccaatggaaagctgttatgtcaacattgaaaatttgttgttttgtgtagccaccttcatccattgtcttagctagatctgaacaatttgctgcagcttctacatcagcacttgttgcttcgccttgcactgttttgttatggagatgacttctttccttaaatctcatgaagcaacctctgttagtctcatacttattctgtagcttcttcacttcttttagcctttacaaaattgaagagagttagggccctactctggattaggtttgggtttaaggaaatgtagttggcttgatcttctatccagacccatcaactttatatatcatcagtaagcctgtttcacttttttaccattcatgcattcactagagtgcatggcctctttcaagaacttctggtctctttcaagaacttttctttagtactcacaatttggccgtttggcacaaaaggtctcccttttggcctatctcagcttttgagatgtcttccacaataaggcatgattgtctaccttttaatttaaagttaaagatgtgcgatctttcctttctcttgaacacttggaggtctttgtagtgttattaactggcctaattttaatattattgtgtcttagggagtagggaggcctgaggagagagagataggggaacagccagtgaatagagttcttagaacacatgaaacattaatcaattaagttcactgtcttatgtaggtgcatttgtgaagtctcaatagtaacatcaaagatcaaagctcattggtcacggatcattataacagtcataataataataaaagagtttgaaatattgggagaataaccaacatgtgatacaaagacacaaattgagcacatgctgttagaaaaaagaattactcaaggcagtgttgccacaaaccttcattttgtaaaaaaggcaatattgcaaagcacaatacagtgaaatacaataaaattgtatgcctataccattttttgttttgatagttattatcattagttataaatgtttttagctttccatttttagcaattcatgaacatgattcaatgttttagtcatgaattattttgacatgcatcattttattttcaaacttttattactaacatttatactatttgtttctaacttagtggcattgagaatcctggtttcagattacaatgcaattaaataagaaactaattttaaataaattcaatttgaaagaactcatcattgttcaaatatctcatttataatatattttcttatttgtgtattcttttcgctatccttatttttgcttattgtttctttttactttactcctgcattcagttagatagataaatttttcaatttaattcttttattttgttcatatggaagtggatttttttcttattgtcttagtagttttccttaaacacttaacataatgtttacatacaaatatttcttcaaatgtctaaaggcattcagcatctcaaacttaaagtgtaaacaactatgttttccacttcaaataactatttgaagaaacttattttcataatatttcttaaacaagttcctcttccagctactagtcatttttctgcctccatttgcagtactttctcctggaaagtgttatctatttccattctctttcaaatttacactcattaggcttttatttcaaccattgtaaggtcagtagttctcaaagttagcaatgaccttcttattgctaaatgtgttagtcttttatttgtactcatcttattaatcaaatgcatttggtcagtgatacagtttgaatgtttgtctcttccaaatctcatgttgaaatgtgattcccattgttggaggtggggcataatgggaggtgtttggctatgagggtgaacttctcatgaatggcttggtgctgtctctagggtaataagtgagttctcactcttagttcttgtgagagctggttgtttaaaggatcttggcacttctcccttgctctctcttgctcctgctctcatcatgtgatgcacatcctccaccttcacattctgccatgattgtgagcttgttgaggcccctaccagaagcagatgcttccgttatgctttctgtacctgttgcagaactttgagtgaattaaacctctttttaaaatgcattacccagcctcaggtattactttatagtaacacaaggatggactaatacaatcaattactttcccttggtactcattatttacttggcttctatcacatcctctttactttctttctagctcactcgtgtcaaagaaaacttacagcaggccacttaaacagagaagcaagaagatcactcaataggtatcaaggcttttgcaataagggagagagattgaactgaatcaatctctgattgagctgaaacaaagggcaggaggatttccaagagctgggtatgctattggagaagtagtggaggatgaactttagtggagaggtttggtcaatgtgattaggtcatttgtgtttgctgcttagcacttatcaaaattaggctcttgctcttccagacagactgggagatcagggtgctttcttcctccatgattacatttcaaagagatggctctaaggtccttgagaaagacattcttggttggaaaagctggaaagaagataggaaaaagcatttggcaaaattcaacaccctttcatgataaaacactaacaaaactagtaatagaaggaaattaccttaacataacaaaggttgtatatgaagagcccacagtaaagatcatactcgatgacgaaaaactgaaagcttttcctttaagataaaggacagtacaaggtagctgttaccctttctattcaaaataatatgggttggatatccctcatctgaaatacttcattccagaagtgttttggattttagattttgtaatatttttgcatcttcataatgagatatcgtgaggatgggacccaagtcctgaacaataactctatttctgttttatagacaccttatacacatacctaaagataattttatatatttgtaataattttgttcatgaagcaaactttgtgtatgtgaaattaggtgtggaattttccatttgtggcaccatattggtgcccaaaatgtttttttttttttgtaacattccagagtccgaatttttggattagaaatgatcaacctgtattaggagacttggccagataaactaggcaagaaaaataagcaaaaagtatccaaataagaaaggcgcagaaaagatcctactaggatggccattataaacaaaagcaaacagacagacagaaaataacaagtgctgatagggatgtgaagaaataggaaactttcttgcactgtttttgggaatgtaaaatgatgtagctgctatgaaaaacagtatggaagttcctcaaaaacataaaaataaaactaccatatgtgattatttatctatgtgaaaattatctacatttatagatgatatgatcttatatgtagaacactctaaagattccacaaaaactgttagaactaataaatgaatccagtaaagtagcaagatataaaattaacatgtaaaaatcagttgtattttcatatactaacagcaaacaatctgagaacaaagtaatagcatatacaatagtatacaaatagtataacaaaatacttggaaataaagttaactaaaagggcaaaaaacttgtatgctgaaaactacaaactgttgctgaaataatttaaagaaacacaaataaatagaaagacataccatgctcttgcattggaagatttaatattgttaaaatgtatatggtaccccaaacaaacagcagattcaatacaattcctataaaaattcccaagtcatttttttcagagataggaaaaaaaatcctaaaattcacatggaactacaaaaaatcccatgtaaaaacaataataggaaataagaacaaagctggagttctcaaacttcttgccttcaaaacacgttacaaatctttagtaatcaaaaccatatgatactggcaaaaaggcagacatataaaccaatggaacataatagagaacccaaaaataaacccacatatatacagttaattggtgatcaaccagaatgccaagactacacaatgaggacagaatagtgttttctacaaatgatattgggaaaactggatatccacagggaagagaatgaaattggacctgtatcatacatgatatacaaaagtaaactcaaaatatattaaagacaatgtaagaactgaaatataaaactcttagacaataatacaggggaaaacttcataacattggtcttgccaatgatgtcttggatatgacaccaaatgcacagacaacaaaagcagaaatcgacaactgggattgtatcaagtcaaagagctgcatggcaaaaggaaaaatcaacagtaaaacaatgaaaaggcaacttatgaaatggcagaaaatacttgcaatgcatatatctggtgaggagttaatatcaatagtatatacaaaatttctaaaacttgaccaaaaattcccaaataatcccgctaaaaaccaggcaaagaagttgagtagacatttctccaaagatgacatacaaatcccaacaaatatatgaaaaaatactcagcatcactaatcatcagggaaatcaaatcaaaactacagtgagatagcatctcactcctattaggatggtcattataaacaaaacaaaacagacaaaataacaagtgttgacaaggaagtaaaaaaataggaaccctttttgcagtgttggtgggaatgtaaaatgatgcagctgctatgaaaaacagtatggaaattcctcaaaaaaaaataaataaaactaccatatgtgatccagtaatctcacttctgagtatttaatacaaaagaattgaaaacaggatttagaagagatatttgcactcccatatttattacagcattattattattttatttatttatttatttatttttttttttgagacagagtcttgctctgtcgcccaggctggagtgcagtggcgcgatctcggctcactgcaagctccgcctcccgcgttcatgccattcttctgcctcagcctctccagtagctgggactacaggcgcccgccaccatgcccgggtaattttttgtatttttagtagagatggggtttcaccgtgttagccagaatggtctcgatctcctgacctcttgatccgcccgccttggcctcccaaagtgctgggattacaggcgtgaaccaccgcgcccggcctattacagcattatttacaatagtcaagaagtgaaaacaatctaaatgtttattgatgtgtggataaaggaaatgtggcatatatatacgcacatattttatatatataaaactatataatatatatcactatatatgtgtatatataataaaatattattcagccttaaaaaaacgaaggaaatgctgtcatatgctacaatattggtgaactatgaggatgttattctaagtgaaataagccagccacagaaggacaaatattgcgggattccatttatatgaggtatctaggtagtcagactcatagtaacagaaagtagaattgtggttgccagagtctgaggaaaggaagaaatggggctgttcaacgggcattttcatcatttaagtaattttagtgaaaaagttatagagacctgctgtacagcagcatgcatccagttaacaatactgccctgtacagttaaaaatgtgttaagaaggaatctcaggttatgaggtttttttaccccctacaatctctctctctgtgtctgtctctctctataatatatacagcatatacataatataaataatatacaaaatatattatatataatataaataggggcaaagatggaagtaagtagaccagttagaaagctaaaaaattatccaagtgacatataatggaggctcaaactaggatagtaaaagtggtatattatatatatattatatataattttatatatataatatatatataattttaatttatatatattatatattctgtatgttatatatttatatataaattaaattttatgtatatatatatatatgcagagtttcctatttcatatcccaagggtttcctatttcatttcctatatttcatatcccaagtctactcacactctgcatgaagtagcttcccattatacacagaataaaagagaaagtttttaccaagtccagtgagacccagcacaagtcagtttccaagtactgcttgaattcatctttcgtttttctcatcatctggctcattttgttctagctttctggcctttttgagagtcattgaatgcttcaagcattctcaactcaggagcttaacactgactgctccctttttctggtgtgctcgttcttgttttctgtatagatggcatccatacctgctttaagtctttgatcaaatcaccccttctcaatgacacctaccttgaaaactctcttgcagccaatctccccaaacctgctactcccattgtgttttttgatcctcttaattccgtatatttttgtttttccatgacacttactatgtttatcatactatatgaaaggaatcaatgggaattagaaaaagacagacttgaaatatattttgaaagtaaaaatggaatatttaaaatttaaattcactcattcatattcagatatttgtttattccaaaattaacccatcattattccatttcttttctcattcctttattatatgcctctatgataccagaacgtaagcttcacaggtttggctttatttatttttttcactaatgtatccctaaatcaagactgacacataaatgtattttgagtgaataaaggatgggtaaagctttttaaatcatcatcggaaataaaacctgtgtctctggggctcctcgttcttcttttttctagtttgtattttagattcaggtgtacatttgtaggtttgctagatgggtaaattgcatgcatgagtgtatggtgtacagattattttgtcaaccaggtaataagcatagtatctgataggtagattttcgatcttcatcctcttccaccttccaccctcaagtaggctccaaagtctattattcccttctttgtgttcatgtttactcaatgtttaactcccatttataagacaaaacatgcagttcttggtttttccattcctgcattagtttgctcaggataatagcctctagtggcaaaggacatgatttcattcttttttacggctgcttagaattctatggtgtgtatgtatcacattttcgttatccagtctaccactgatgggcatttaggttgattccttgtctttgatattttgaatggtgctgcagtgaacatatgcatgcatgtgtgtacatgataaaataatttatattgctttgggtatatacccagtaatgggattgctaggtcaaatgttaattttgttttaagttcttggagaaatctccaaactgctttccacagtggctaccttagtttacatcctcatcagtggttatacgtgttctctttttctctgcaacctcacaagaatctgttattttttgcctttctagtaatagtcatgctgactggtgtgagatagtatctcattatgatttgatgtgcatatttgtatttctaatgattagtgatagtgagcatttttaatatgcttgttggctgtgtgtatgtcttcttttaagaagtgtctgtgcattcttttgcccatttttaataagtttttttgtaaatttgtttaagttccttatagaagctgaatattagacctttttttgatgcatagtttgcaaatattttctcccattctgtgggttgcctgtttacactgctgatattttcttttgctgtgcgaaagctctttagtttaattagatcccacatattaattgttgtttttgctgaaactgctgttggagtctttgtcatgtcgttttcttccagggtttttatagtttttggttttacatttaagtctttaatccatcttgagttgatttttttattttattttattattattatactttaagttttagggtacatgtgcacaatgtgcaggttacttacatatgtatccatgtgccatgctggtgtgctgcatccattaacttgtcatttacattaggtatatctcctaatgctatccctcacccctacccccaccccacaacagtcgccagagtgtgatattccccttcctgtgtccatgtgatctcattgttcaattcccacctatgagtgagaatatgtggtgtttggttttttgttcttgcgatagtttactgagaatgatgatttctaatttcatccatgtccctacaaaggacatactgagaatgatgatttctaatttcatccatgtccctacaaaggacatgaactcatcattttttatggctacatagtattccatggtgtatatgtgccacattttcttaatctagtctatcattgttggacatttgggtgggttccaagtctttgctattgtgaatagagccgcaataaacatacgtgtgcatatgtctttatagcagcatgatttatagtcctttgggtatatacccagtaatgggatggctgggtcaaatggtatttctagttctagatccctgaggaatcgccacactgacttccacagtggttgaactagtttgcagtcccaccaacagtgtaaaaatgttcctatttctccaaatcctctccagcacccgttgtttcctgactttttaatgattgccattctaactggtgtgagatggtatctcattgtggttttgatttgcatttctctgatggccagtgatggtacgcattttttcatgtgttttttggctgcataaatgtcttcttttgagaagtgtctgttcatgtcctttgcccacttttggatggggttgtttgtttttttcttgtaaatttgtttgagttcattgtagattctggatattagccctttgtcagatgagtaggttgagaaaattttctcccattttgtaggttgcctgttcactctgatggtagtttgttttgctgtgcagaagctctttagtttaattagatcccatttgtcaattttggtttttgttgccattgcttttggtgttctagacatgaagtccttgcccatgtctatgtcctgaatggtaatgcctaggttttcttctagggtttttatggttttaggtctaacgtttaagtcttaaatccatcttgaattaatttttgtataaggtgtaaggaaaggatccagtttcagctttctacatatggctagccagttttcccagcaccatttattaaatagggaatcctttccccattgcttgtttttgtcaggtttgtcaaagatcagatatttgtagatatgtggcgttatttctgagggccctgttctgttccattgatctatatctctgttttgggaccagtaccgtgctgttttggttactgtagccttgtagtatggcttgaagtcaggtagtgtgatgcctccagctttgttcttttggcttaggattgacttggtattgtgggcacttttttggttccatatgaactttaaagtagttttttccaattctgtgaagaaagtcattggtagcttgatggggatggcactgaatctataaattaccttgggcagtatggacattttcatgatgttgattctttctacccatgagcatggaatgttcttgcatttgtttgtatcctcttttatttcattgagcagtggtttgtagttctccttgaagaggtccttcacatcccttgtaagttggattcctaggtattttattctctttgaagcaattgtgaatgggagttcactcatgatttggctctctgtttgtctgttattggtgaataagaatgcttgtgatttttgtacattcattttgtatcctgagactttgctgaagttgcttatcagcttaaggagattttgggctgagacaatggggttttctagatatacaatcatgtcatctgcagacagggacaatttgacttcctcttttcctaattgaataccctttatttctttctcctgcctgattgccctggccagaacttccaacactatgttgaataggagtggtgagagagggcatccctgtcttgtgccatttttcaaagggaatgcttccagtttttgcccattcagtatgatattggctgtgggtttgtcatagatagctcttattattttgagatacatcccatcaatacctaatttattgagagtttttagcgtgaagggttgttgaattttgtcaaaggctttttctgcatctattgagataatcatgtggtttttgtctttggttctgtttatatgctggattacatttattgatttgcatatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggtcgtgtctctgcccggctttggtatcaggatgatgctggcctcataaaatgagttagggaggattccctctttttctattgaatggaataatttcagaagaaatggtaccagttcctccttgtacctctggtagaattcggctgtgaatccacctggtcctggactctttttggttggtaagctattaattattgccacaatttcagagcctgttattggtctattcagagattcaatttcttcctggtttagtcttgggagggtgtatgtgtcgaggaatttatccatttcttctagattttctagtttatttgcgaagaggtgtttgtagtattctctgatggtagtttgtattactgtcagatcggaggtgttatcccctttatcattttttattgcgtctatttgattcttctctcttttcttctttattagtcttgctagcgttctatcaattttgttgatcctttcaaaaaaccagctcctggattcattaattttttgaagggttttttgtttctctatttccttcagttctgctctgattttagttatttcttgccttctgctagcttttgaatgtgtttgctcttgcttttctagttcttttaattgtgatgttagggtgtcaattttgtatctttgctgctttctcttgtgggcatttagtgctataaatttccctctacacactgctttgaatgtgtcccagagattctggtatgttatgtctttgttctcgttggtttcaaagaacatgtttatttctgccttcatttcgttatgtacccagtagtcattcaggagtagattgttcagtttccatgtagttgagcggttttgagtgagtttcttaatcctgagttctagtttgattgcactgtggtctgagagacagtttgtcataatttctgttcttttacatttgctgaggagagctttacttccaactatgtggtcaattttggaataggtgtggtgtggtgctgaaaaaaaatgtatattctgttgatttggggttgagagttctgtatatgtctattaggtctgcttggtgcagagctgagttcaattcctggatatccttgttaactttctgtctcattgatctgtctaatgttgacagtggggtgttaaagtctcccattattattgtgtgagtttgacgagttgagagaagaaggcttcagacgatcaaactactccgagctacaggaggaaattcaaaccaaagacaaagaagttaaaaactttgaaaaaaatttagacaaatgtataactagaataactaatacagagaagtgcttaaaggagctgatggagctgaaagccaatgctcgagaactacatgaagaatgtagaagcctcaggagccgatgcgatcaactggaagaaagggtatcagtgatggaagatgaaatgaatgaaatgaagtgagaagggaagtttaaagaaaaaagaataaaaagaaacgaacaaagcctccaagaaatatgggactatgtgaaaagaccaaatctacgtctgattggtgtatctgaaagtgacggtgagaatggaaccaagttggaaaacactcagcaagatattgtccaggagaactttcccaatctatcaatgcaggccaacattcagattcaggaaatacagagaacaccacgaagatactcctcaagaagagcaactccaagacacataattgtcagattcaccaaagttgaaatgaaggaaaaaatgttaagggcagccagagagaaaggccgggttacccacaaagggaagcccatgagactaacagcggatctctcggcagaaaccctaggagccattagagagtggtggccaatattcaacattcttaaagaaaagaattttcaacccagaatttcatatccagccaaactaggcttcataagtgaaggagaaataaaatactttacagacaaacaaatgctgagagattttgtcaccactaggcctgccctaaaagagctcctgaaggaagcactaaacatggaaaggaacaactggtaccagccagtgcaaaatcatgccaaattgtaaagaccatcaaggctaggaagaaactgcatcaactaacgagcaaaatcaccagctaacatcataatgacaggatcaaattcacacataacaatattaactttaaatgtaaatggactaaatgctccaattaaaagacacagactggcaaattggataaagagtcaagacccatcagtgtgctgtattcaggaaacccatctcacgtgcagagacacacatacactcaaaatgaaaggatggaggaagatctaccaagcaaatggaaaacaaaaaaaggcaggggttgcaatcctagtctctgataaaacagactttaaaccaacaaagatcaaaagagacaaagaaggccactacataatggtaaagggatcaactcaacaagaagagctaactgtcctcaatatacatgcacccaatacaggagcacccagattcataaagcaagtcctgagtgacctacaaagagttgatttttgtatatggtaaaaggaaggggcccaacttcaattctctgtatatggatagccagttattcctatatcatttattaaatagagagttcttttcccattgtttcttattgtcaattttgttgaagatcagatggttgtaggtgtgcagcattgtttctgcactctctattctgtactattagtctagatgtctgttttttatgccagtacaatgctgttttggttactgtaccctatagtttgaagctgaatagtgtgctgcctccagctttgtgcattttgcttataattgctttggctgtttgggatcttttttggttccatatgaattttggaatacatttttttttctaattctgtgaaaaaggttgttggtagtttgataggaatagcattgaatctgtaaattgacttggacagaatgggcatcttaacaatattgatttttcctatccaagggcatggaatgtttttccgtttgtttgtgtcatctctgatttccttcagcagtgttttgtaattctcactgtagagctccttcacttctctggttagctatcttcttaagtattcaattctttttctgactattatgaatgggagtgtgttgttgatttggctctaatcttggatgctactagtgtatagaaatggtactgatttttgtacattaattttgtatccagaaacttgatattgtttcttgatccagaaacttctgttgtctccagaaacatgaagatgtttatcagatctaggagcctttgtgcagagactgcaggtttttctaggtatagaatcatattgcttgctaatattgtttggctgagtccccacccaaatctcatcttgaattcctccatattgtgggagggacctgatgggagataattgaatgatgggggcaggtctttcctgtgcttttctcatgatagtgaataagtctcaccagatctgatggtttttaaggtggagattccctgcacaatctctctctcttgtctgccaccatgtgagatctgccattcaccttctgccatgattgtgaggcctccccagccacgtggaactgtaagtccgttaaacctccttattttgtaaatttcccagtctcgggtatgtctttatcagcagcatgaaaacaggttaatacagtaagttggtactgggaaggggttagtgctgaaaagataccctaaaatttggaagagactttggaactgggtaacgggcagaaattggaacagtttggagtacttagaagaagacagaaaaatgtgggaaagtttggaactccctacagacttgttgaatagctttgaccaaaatgctgacaatgatatggacaatgaaattcaggctgaggtggtctgagatggagttgaggaacttgttagaaactggagcaaaggtgactcttgttatgttttagcaaagagactggcagcattttgcccctgccctggagaattgcggaactttgaacttgagagagatgagttagggtgcctgtcagaagaaacttctaagcagcaaagcattcaagagttaacttgggtgttattaaagacattcagttttctaaggaaatgcagcataaaaattcagaaaatttgcagcctgacaatgcaatagaaaaaaaaatcccattttctgaggaggaattcaagccagctgcagaaacttgcataagtaaggaggagctgagtgttactccccaagacaatggggaaaatgtctctagggcatgtcagaggtcttcatgacagcccctcccatcacaggcctgcaggcctaggaggaaaaagtggttttgtggttttgtaggctgggtcttgagtccctgtgctgtgtgcagcctagggactatgtgccctgtgtcccagctgctgcagctgtggctgaaaggggccaatatggagctcaggccatggcttcagagggtccaaaccctaagccttggcagcttccacatgatgttgagcctgtgagtgcacagaagtcaaaaactggggtttggaaacctccgtctaaatttcagaagatgtatagaaatgcctggatacccaggtagaagcttgctatagcagtggagtcctcctggagaacctctgctagggcagtgcagaagggaaatgtggggtgggagcccccacacagagtccctactggggcaccacctagtggacctgtgagaagagggccaccatcctctagaccccagaatgatagatccaccaacaacttgcaccatgcaccaggaaaagccacagacactcaatcccagcccatgaaaacacctgggagggaggctgtaccttgcaaaaccacaggggctgagctgcccaagaccatgggaacctacctcttgtatcagtgtgacctggatgtgagacatggagtcaaaggggatcattgtggagctttacgatttaactgcctgctggattttggacttgcatggagcctgtagcccctttgttttggccaatttctcccatttggaatggctgtatttacccagtgcctgtgcccctatagtatctgggaagtaactaacttgcttttgattttacaggctcataggcagaagggacttgccttgtctcagatgcgatgttggactgtggacttttgagttaatgctgaaatgagttaagacattgggggattgttgggaaggcatgattggttttgaaatgtaaggacatgagatttgggaggggccaagtgtggaatattatggtttggctgtgttcccatccaaacctcatcttgaattcccatgtgttgtgggaggaattcaatgggaggtaattgaatcatggggacaggtctttcttgtgctattctcaagatggtgaataagtctcacaagatctgatggtttttatggggaaagaagaagagctaactatcctaaatatatatgcacccaatgcaggagcacccagattcatataacaagttcttagtgacatacaaagagacttagactcccacacaataatagtgagagactttaacaacccaccatcaatattagacagatcatcaggacagaaaattaacaaagatattcaggaattgaattcagctctggatcaagtggacctggttgatatctacagaactctcaacaccaaacagcagaatatacattcttcttggtgccatatggcacttaatctaaaatttattacataattggaagcaaatcactcctcagtaaattcaaaataactgaaataataacaaacagtctttcagaccacaacacaatcaaattaaaacatgtggttaagaaaatcactcaaaaaccacacaactacatggaaattgaacaacctgctcctcagtgactcctgaataaataatgaaattgaggcagaaatcaaggagttatttgaaaccaatgggaacaaagacacaatgttccagaatcacagggatgcagccaaagcagtgttaagaggcaaatttataatactaaatgcccccatcaaaaagctagaaagatctcaaattgacactttaatataagaaataaaatatctagagaaccaagagcaaacaaactgcaaagcaaagctagcagaagacaagaaataaccaatttcagagtggaactgaaggagatagagacacaaaaaaaaccttcaaaaaattattgaatccaggtgctggttttttgaaaaagaaaataaaatagaccactatctagactaataaagaagaaaaaaagaataaaagagacaataaaaaatgataaaggggatatcaccactgaccccacaaaaatacaaacaaccatcagagaatactataaatagctctatgcaaataaactagaaaatcaagaagaaatggataatttcctagacacatacgcccttcccaagactgaaccagaaataatttgaatccccgaatagaccaataacaagtttgaaatttgaggcagtaatagtctaccaaccaaaaaaaaagcccaggaccagatggatttacagctgattactcccagaagtacaaagagcagctgatacactttcttctgaaactccttcaaattattgaagaggagggactcctctttaactcattctatgagcctagcatcatcctaataccaaaaccctggtagagatacaacaaaaaagggaaacttcaggccaataaccctgatgaacatcagtgcaaaattctgaataaaatatgggcaaaccaaatccagcagcacatcaaaaagctcatccataatgaaaaagttggcttcaacccccagatgcaaggctggttcaacatttgcaaatcaataaatgtaattcatcacataaacagatctaaaaacaaaaactacataattatctcaatagatgcagaaaagtacttagataaaattcaacatccctttatgttaaaaactcttaataaactggctactgaaggaacatacctcaaaataataagagccatttctgacaaacccgtagccaatatcatactgaatgggcaaaacctggaagcattcccccttgaaaactggcacaagacaaggatgctgtctcttaccactcctattcaatgtagtattggaattgctggccagggcaaccaggcaagagaaggaaataaagcgcattcaaataggaagagaggaagtcaaattgtttgcagatgatctgattctatatctagaaaaccccatcacctcagcctaaaagcttcttaagctgataaacaacttcagtaaaatctcaggatacaaacttaatgtgcaaatgtcacagcatttctatacaccaacaacaagcaaacagagatccaagtcatgagagaactcccacttgcaatgctacaaagagaatgaaatacctaggaatatagctaacaagggaagtgaaggacttcttcagggaaaactacaaaccaatgctcaaggaagtcagagatgatacaagcagatggaaaacattccatgctcatggataggaaggatcaatacagtgaaaatggccatattgctcaaagtaatgtatagattcaatgccattcccattgacattcttcacagaattagaagaaactatttaaaaattcatatggaactaaaatagagctcatatagccaagacaatcctaagcagaaagaacaaagctggaggcatcaaactagactacaaggctacagtaaaaacaaacaaacaaacaaacagacaaaaaaaagtatggtacttctacaaaaacacacacacagaccaatgaaacagaatagagaactcagaattacgaccacacatctacaactatctgatctttgacagacctgacaaaaacaagcaatggggaaaggattctctatttaataaatggtgctgggataactggctagccatatgcagaaggttgaaacaggaccccttccttacaccttatgcaaaaattaactcaagatggattaaagacttagatgtaaaacatgaaactataaaaactctagaagaaaatctaggcaatatcttttaggacctaggcataggcaaatatttcatgatgaaatcaccaaaagcaattgcaacaaaagcaaaaatcgacaaatgggacctaattaaactaaagagcttctgtacaacaaaagaaactatagtcagagcaaacaggcaatctacagagtgggagaaaatctttgcaatctatctatctgacaaaggtctaatatccagaatctacaagaaacttattaaacaaatttacaagaaaaaaaaacaaaccaccccattaaaaaaggggcaaaggacatgaacagacacttctcaaaagaagacattcatgcagccaacaaacttatgaaaaaaggctgaggctgggtgcagtgattcatgcctgtaatcccagcactttgggaggctgaggcgtgtgaatcacgaggtcaggagttggagaccagcctggccaacaaggtgaaaccccatatctatgaaaaaatacaaaaattagacaggtgtggtggcacatgcatatagtcccagctacgcaggaggctgaggcaagagaattgcttcaacccgggaggcagatgttgcagtgagccaagattgcgctattgcagtccaacctgggtgacagagcaagactccatccgtcttaacaaaaaaaaaaaaaaaaaaagagaaaaacagaaacatcactgattattagagaaatgcaaatcaaaaccaaaatgagacaccatctcataccagtcagaatggcgattaaaaagtcaaaaaacaacagatcctggtaaggttgcacagaaataggattgcttttacactgttggtgggaatataaatcatttcaaccattgtggaatatactgtggcaattgctcaaagatctagaaccagaataccatttgacccaacaatcccataactgggtatatacccaaaggtatataaatcattctattacaaagataaagacacatgtatgttcattgcagcactcttcacaatagcaaagacatggaattaaacataaatgtccatcaatgataaactggataaagaaaatgtagcacattttcatcatggaatactatgtagtcataaaaaggaattagatcatgtcctttgcagagacatggatggagctggaagccattatcctcagcaaactaacacaggaacagaaaccaagcaccacatgttctcatttataagtgggagctgatcaatgagaacacatggacacaaggaggggaacaacacacactggagcctgttgggggatggtgttggggaagggaggacattaggaaaaataactaatgcatgctgggcttaatacctaggtgatgggttgatagctgcagcaaaccaccatgacacatatttacctacataacatacctgtacattctgcacatgtaccctggaacttaaaataaaaataaatgataataatctctgatgggttttttttttatatttctgtggggtcagtggtaatatcccctttgtcattctaattgtgtttatttggatcttctctcttttttctttactagtctagcttgtggtctaccaattttgtttattctttcaaaaaaaccaatgttttctgatgttttgtatggttttcatatctcattttcattcagtttagcattgatattggtaatatcttttcttctgctagctttgtggtttgtttgctcttgttttcctagctcctctaggtttgatgttagatcataaattggaaatctttttaactttttgatgtgggcatttatcattttcagctttcctcttaaaattgctttagctgtgtcctggagattctggtatgttttatctttcttttcatgaatttcaaagaatttcttcatttctgccttaattttattatttacccaaaagtcattcaggaacagattgttgaatttccatgtaattgtatggtttggagagatcttctttgtattgatttctattttgattgcccagtagtcccagagtgtggttgatgtcaggatttttgaatttgttgagaattactttatggctgagcatgggatcaattttagagtatatgccatgtgcagatgagaagagggcatattctattgttgttcagcatagtgctctgtagatttctgttaggtctatttggacaagtgttgagtttaggtcccaaatgtctttgttagttttctgcctaggcgatctgtctaacactgtcagtagggtgttgaagtctcccactactattatatgtttatttaaatctcttcggccgggcatgatgcctcacgcctgtaatcacagcacttagggaggccaaggcaggtggatcacgaggtcaggagatcgagaccattctggctaacatggtgaaaccctgtctctactaaaaaatacaaaaaaattagctgggcatggtggcgggcgcctgtagtcccagctactcgagaggctgaggcagaagaatggcacgaacccagaaggtggagcttgcagtgagctgagatcgtgccaccgcactccagcctgggtgactgagcaagactctgtctcaaaaaataaaaaaattaaagaaaaaaaatctcttcataggtctctcagaactagtttcataaatttaggtgttttggtgttaggttcatatatatttagcatacttaaattttcttgttaaattgaactttttatcattatgcaatgcccttctttggttttggggttttcttttttggaccattgtttgtttaaagcgtttttttttgtttgtttgttttttgaaataggaattgcaacccctgttcttatttgttttctgtttgcttgatagatttttttccatacctttacttggaatccttgcatgtgagatggttatcctgaagacagcgtacagttgagtcttgcttctttatccaacttgccattctatttttttaagtagggaatttagcctatttatgttcaaggttaatatttatatgtgcagttttgatctgtcatcatgttgttaactagttgttatgtagacttgactatgtagttgctttataatgtcaatggtctatgtagttaagggtgtttttgtagtggccagtaatagtcttaaggacctcttgtaaggcaggtatggtgataataaattttgttagcatttgcttgtttaaacagaattttatttcttctttgcttatgaagcttagtttggctggatataaaattcttggttgaagtttattttctttaaagatgctgaatataggtccccaatctcttctggcttgtaagattcctgctgaaagttctgcagtagctttattcaattccctttgtgtgtgatctgcccctttcctttggctgcttttaatatttttttttcgtgttgactttggagaatctgatgattatgtgtcttggggatcatcatcctgtatagtatcttacaggggttttgtacatttcctgaatatgattgttgacttatgtagcaaggttggggaaattttcatggacagtatccttaaatatgacttccaactggcttgctttctcttcctctttttcagagacaccaatgagttacagatttgttccatttacataatcctatatttctcagaggttttgttcagtcttttttattctttttttcctttatttttatctgactgaattgattcaaggaaccagtcttcaagatgtgagatctttcctcagcttggtctattctactgttaatacttctgattgtatgaaaaagttctagtagtgagtttttcagctctatcagatcagtttggttctttcttaaaatggctactttgtctttcagctcttctgttattttactggattccttagattccttgaattgggtttcaaattgctcctgaatctcgataaatttgttgctttccctgttcttaattctttgtctgtcattccagcacttctgcctttttaaaaaccatggctggggagctggtggagtcatgagaaggtaagaaaacactctggtttttgcgttgccagcgttcttgcactggttcttctcgtctgtgtgggctgatgtccttttaatcttagaatttgctattctttggatggagctttttgcttatatattatttgacgtccttgagggtttgactatgggataagtttgagtacagttggcttgcttcatttctggatgatttcaggggggcaaggctcagctcagcactcttgagtggcatgctctaaccaggcccacagctttgttccctgacccctcaaggttgagcacctggtgagctgaagaagttgaggtattcccagatcgtggaaacaacactctgatgtgggagggagctgtgccaacaacaacactctaattgggcatgccagcaaatgcactttgtcagtgtggtggcagtgttgtttacgcttatgtatgcatgccagtggtggcagggtctgcacatgtgcatatgccagtgagctccatgtgcacacgtgtgctggtggtagcagtgtggtgagttgcacacatgtgtgcatgagtaaaacaataggggggctgcaagtgagtgtgtgcactcataaaatggtggggaaaggctgagggcaggtgcacgccagtgagggaccatctgcagaagctctgatggttagtaagggtctgcaagcaaaggagttatggtgttggctgttgggtggtgccttggttgtgtatctgaagctgtgctgcaagtggatgtggccagacaggaaccttgggagaaatcagcagacaggggggatgctcagatcggactggtaccacctcacaggcaagatagctttgttctacctgggtacaactgccaacaaaggccaaagctacctagaggagtgttgtgagccttaggggttggccatccctggcagtattccccttcagctgtttcatgctaaaccccctggggttcgcacaggctggagtcttgtcccttccaactctccaagcagctctctctgacagctcaaatgtccatggttgtcatggggtcttcagcagctaggattcttgaagtctgtggtgacagtgggccactcaattcctatttaatttgctccttccctaggaggcattcagggccaggaatgagtcctggtgcttagcaaccctgtgcagggtttccagcttcctccttcttcagcccagcatgtgttttctccttccattcactctcaatgccttccttccaaagatctgcttggaatgtgccagtcttcttgatggtctggtatcttggtgggatcagctattcctggctgtgtttagttgaccatcctggctcttctccagataaaggctttgatgggtgaaaaatgtatttgtttcccctaaatctaaagattaaagagcagtgctgaataggcaagaaagcaaagctggtttagagtgcaaagagaaaactaggaggataggtttcatataggaaacaaatgacaagtgaacctggaaaagatgagctagacttcctgtgttgggtcttacatattatggttcagaataccagctctggtttaaattagtggagtttgaatgccttttctgccactttttagctatgtaatttgaccagatattacactctatttcttgtttgaaacattaaacaagttaataaatctagtgtgacttaaattgtgccaagtaagttatatgttttagccattattattatctaggtcaccaaatattcaaaagccataatttcttttgaagttgggaataaagtaatccatatactcatttataaatatttatttgtcagagttttgcaggatggatagaagccaggacagtgtggaagcagagatgccaatttgaaagggtttgtagtgactgaagttagagctaatgtggataaattttgacagtgccagtgggactggtaccaggcattggatgttggtacagggctaggcagatcttggatctggagggtgacaacaaatatgcaggcaaagatgttggaggttttgtgcctgggttacagagagaatgtgtttttaacagaaatagattaatcagagagatggtctctctggaatgatgctggattcattttggaacaagcttatgtctgaatatgaatcagtatattttattttaaaatattccctttctctcttcaaatatgtatctcatttcttgcatttccctctttttactaactccacctgattttaagcaccttgtttcacattcaatttctgtagtagcctcctaaatgtccttacctttttaaaagataattgtcttactcttttgtttctacctgtctctaatcaattctcttcacactagagtgaggtacttctaaaatgttgatcacatcatgccactctattgtttatccctctttccctgcttcttctttaacttggaataaaatctaaacttttactatggcctctaactacatggtctagcccagtgcatctctgccaggtatactgccactaaccttagaatctgccactgatacatactgtgctcaaacagctccatccatattgcttccaggaaaaggaagggctttttctcaactttcaggtcacagagcaaatttaatttcctctgagagaccttttctgactacactatgtcaagtagactctgaactccagcttctatcattattccctaggtagccaagaggaaatgggaaaaagaataaaaatgtaaggatttttattttaccagagaaatgtcatttattccgtagttacaaaatgaaaggaaaataagagcacagatctaaagacacaaaaagatttggtggtgagaagattcccttttaactgtctcagggcagttggcatggtttcattgtcccacccaaatcctaaaagagggctgcttacatttttgggaaaagtgttcaaggacaaaattctggatttgaaactgccaaaaaccctagatttaaccttttttttcttcaccttgttcctggaaaatagactaggtacggataaaactgtcctgttaaaagtcagtaggcaacagggattcagtatatagaggtaatactaatttaaaaaatgaaaaaaggataaaaggataaatgcttattaaaaattccatatttcactcaagaaacaaaagtacttcatgtaaagagttttccttaaaaaattaagacatggactcattttgtttcatttttatgattgttgctattggtctttaaaatttacatacaggaaacagctttttttggtatacatttctgagtttaatacatgtattgattcatgtacccgtcactacaattagtctgtagaagagttccagcagattctttgtagtcaaacctactgttacccttaacccttggaaactgtggatctgttcttcattcctatagttttgccccatctaaaacattatatacttggaatcataaattatataaccttttgagactgtgttaattcagcataatgcctttaagatttgtccatagtgttgcatttattaatagttcattctttttattgctgaatattattccattatatagatgtaccttagtttgtttattcgctcaccttttgaagaacatttaggttgtttttagtttttgatattaatacttaggagtactgctgccaagatcatttatgaacacgtttttgtgtgaatataagttttgttttgtttttctctgttagaaatgtgattcctgtgtcattgggtaagtgactttataagaaaaagacaaactttataagaaaaagacaaactcttttgtggtagagttttatcgttttgcattctttttagcaatctataatatttcccattgctccatatcttttccagcatttggtattgtcagctcttcttttttaatggatagtgatgttgagcacatattcatgtgcttatttgttaaccatatagtttctttgatgaagtgattgttcaaatctttctcctcattttaaaaaagcattttttttttcaattgagctttgggaattcattatatattctagagatgtcattttcattctcttgtcagtgtcttttgcaatacaaaaattttggagttgatgtgatcagtttacatttcatcagaagacatttagtcttttgttttcctctatatgttttatagctttacatttcataaataactctatgatccatttccagttaatctttatataagatgtgaggtttagatgaaagattattgcggcttgttttcttcttttttttttggtacaagaatgctcactttccccaacatttgttgaaaatacaaccaatatcccatttaattgcttttgcccatttgtcagaaatcaatttgacttatttgttggggcctgttaatagactctttattctacttattgtattaggttggtgcaaaagtaatcacaatttttgccattactttcaatgacaaaaccacagttacttttgcaacaacctaatatctttcaacccaagggaatgatatgcccttttatctatttgggtgttcttagatttgtgttatcataaagtttttagcatatcaagcatgcatatattttataatatttatttcagtttccaaattgttcatttctaataataacataaattttttatgttgatcttgtgtcttgtgactgttaaactgttttattagtttcaggaaattttcttataaattctttgcaattttctaggtagatgattataacatctgagaatatacatttatgcttattttttcaatttgtaaaaattttattttaaaatttacatttgttattcttattagtgtttggctttactgcactagttaggacttttatggtattaaataaacatggtataaatgaacatctgtctctttgtcccatcctcatgtgaaaacattcagtctttcaccactaagtgtgatggtagctgtcgtgtctttacagattcccttcctcgaatttagaaagtttttctgaattcttaatttgctgagaattgctttttgtttttaaaatcatgaatagatgttgaatattgtgaaattatttttcttttgtcagttgatatgatcatgtgtgttttattccttattctgttaatatatggattatattgctggttttcaactattgaaccagctttgcattttagataattcccatttgattgaggcttattattttttatgctaagattttattgaggaattttgcctccgtgttcatgagcaatattggtctgtaatgttctttccttttattttttaaaaaattattctctttgactggtttatatatcagagtatgtctatgtctcataaaatggtctcataaaataagttgggaaatattcctttcttgtttattttctggaagcaagtatatataattagtatatttcttctttaaaattttatagaatttcccagtaaaagcatctgggtttggggtatttttttccctttggatgcatttaactaggatttcgatatctttggtagatgtaagacaattcagattatctatttcctctttgatgagccttggtagtttgtagcattcaaagaattggttcatttcatctaagatgttagagttatattatatgagattgattacaataacatcttgttatgttttccatgtctgtgggctttgtagtgctaatacctcttttatttctgatattagtaatttgaaccttctctctatttttttctccttatagctagaggattattaatgttattgatattttccttaaaaatcttttgatttcattgattcttccttttattttgctattttaaatttcatcatgttctgctctttatcatttctttccttctacttgatttttactctttttaaaaaaattctcaaaatcatttcttacgtaatttaatctggatcttccttcttttctaatataaacatttactgctctaagtttttctttgagcactgatttaagttgcatccctaaaattttgatatgttttattttcaattttattcagttaaaatattttctagttttccttgtagtgtcctctttaacttatgggtaatttagaagtatgtaaatttccaagaattttggtattcccagttttattactgatttctagtttaattttattatgctcaagaaatatatttttaaatattttaatttaaaaaaatatgttgagacattatgacccaggatattttgtctgtgtagtgaattttttttctctttttcttttttttgagatggagtctcgctttgttgcccaggctggagcagagtggcgccatcttggctcaccacaacctccgcttcccaggctcaagagattctcctgcctcagcctcacaagtagctgggactacaggtgcataccaccacacctggataatatttacacttttaggagagatggagtttcaccatgttggccaggctggtctcaaactcctgacctcaggtgattcacctgcctcagtctcccaaagtgctgagattacagacatgagccaccacggctggctgtatgtttcttgtgcttttgaaaataatttgtattctgctattactggctagagtattgcttaaatgtccattagacagagttggtcactggtgtttttcaattcctctatatcctttttatttgttgtattgatttctgagaggcaaatgatgatacctctagttaaagaatttccccctcctcctttgaatcttttcatttttgcttcatgtattttggagctctgtttttaggtatatacacatttgggatttttttttcctcatccttatttttcatcatttgattctaatgttcctggtgtgaatttctttgagtttatcttatttgatgtttattgagtttattgaatctataagtttatgactttagtcaaatttgagaagtcttaacacattattttttaaatttccttgcaccatgttcatgactgttagacctattaatattttcccacaaattcagaaatctttttttttcctttttttgttcatagtggttaatttttattgatctgtcttcaagttcactgatgtttttgttgtcatctccagtcttctgttgagctgagtgatatttacttttggttatctgatgtttcagttctaaatgttttttggttctgtactatattattttgtttctatgatgggatttctatctttccattcattcccacagtgattatcctttgtactggaacatctttataatagctgctttgcaattattgtctatactaccaacatctgtgtcttctcagtgttggtatgtgctgattttcttttcctttgagagacattgaaatttttttattctttgtatattgaataattttctactatgttctgtacactttgaattttgtcatgtgaatctaggtcttatttaaattatatggagaatacatattttttttgttttgtttttactttagcatgcagttgacctggttaagttcaggttgcacattcttacccttcttttgtaaactgtgggtacaatgtcgctttagttttccaaaatcttttcagtggtatttggatctatcccaaatatgtagtatttggtggctagtcttggattttggaagtgctttatcttatagttaagtttccagaaacctttggtgtgctactcaggttcagatccaccctttcacagctcaaggctgggcccaggaatcgatatataaatttaaagtgttaatttcttgaggttctagtctgcccaaaatcactaaaatcttctgattatcagatactccttttcctggactcctagctgaaaagtcagggccttagtttacctactttgtcacataattcttgagtctgagtctttacctagggctatgaggacaaaatatagggaaaaaaatggggaatttttttttacatgctcttgggactatagttcaactggtctaagagatggatttcctgtctttgtagttttttttgtgtctacccagaaaccattattattactgccaccactaactcagggcagggagagaaagaaagaagcaaacacaaaaatccaggtttcttccactttttttgactcttcaatttttttttcacgtcttaggacaataaatatagggcttctcctggaactttttgttttcacctggtgggtatttccagcttttgtgttgcctttacgttcaggttgggagataatagaggaaaacaaaacaaaacaaatccttctcttctagtttagtggtcctttgaattctggttttctttcccaatctacttggtaccatttacttttcagaatcataacctaagtgttctgtgaatggtctccttggttttagttgcatttgaagtcagtgaaatggtgaagagtacttacaataattaaaaatacattaagtaattatataaagaaatgaaaaccattatcgggagatattagtctctttataaatatgttaaatctggcatttgtcggtaactaaggttaaaaggattgatggaagggttaaagaacactgaagaacttgacagtcattatgcaataggtgtagcttgtatgccagtttgagctttcgtttttggtgggaaggaacactgtagggaaaactggagttttcgtgtgggcaagaacttgtgaaatcaggttttcttttattgaataattccatctgtattcatcgtctggggaaatctatgtaaaagttggtcaaagaaaggacatttctaatgtaattttggagacagtcttattctattaatattaataaattatagagagatgataaaagtagacttaaaatttagaaattaatacagaatttgggctgctgaataaatgatttataatgctagagaatgttgtatgagaaggtagagtaagaaatagcaaattgttttaattcaaattagcaaaagtattaaagatatttggttcattatgtaccaagagagttgatatatatgttaaaaaagaaataacacacaataaataatctacgacttcattagttttggccattattttttaatcttaggcacaagagagtattcacaatcatgttggaaggctgagactaagcacaacaaagagatttttttctctttaatattaccaaaattagaatgtaatctatcagttattaattgtagacaaagtgaattctgttttgaataataattatgtttccattcctggtactttagtattattcctaggagtttatttcttactttttttagacttttaaatttggactttctttttctgtgttttatttaacttttattcatgtctactgatctgatttaaggccatatggttttaaacagtcttccactttccaaatagttatttcttcaatttctatttcttgtgttttttcaatcctgttcttactggaatcaaccttatattactttctctttttcttcctttgtcttttctgataaactatcttctgtttcttcaggataaaataaattttgggatcataacaactgtcacaaatttacctctgaataaataatgtaataacactttaagactctcagattcatcaaatgcttaatgcaaaatcatctagcaactgaatgaaattcctcactctcattgcatatgtttttacccattagttattgggtttgatcatgtttttcttacatctatgcattatattcatacatcagtaaaaaccaagatggaaacttgaatcatcattagatagagaagtggaatggcataataataaaaacaaaacaggaataaattgaactggatgtcccaatgcttgcttccatcagaatcaataaccatttgttagaattaatttctttctaattgtttgtgctaacatattagtttagcattgttttggtcttccacacacagattagaaatgaccaaccatcacaatttcaataaacttcaatttcagtgttctctactgaggggaattgaaaaatgatctagaatgagtcaccattcaattggagacagatgtggatattttagtgtggctctgatatttcatttaatgcaaaaataatggtaacactgaatatacacacacatacaatgctacctttctttttttcaggttgccaacttaattttagagccttgtagtaaatatttaaagttgaactatgacccaacacagctagttataagtacaggtacattgattttctccaaaccaaaaagtacgtagagcttaggaacccttactaaggctaagtctgccttggttttaattccaactctgccatcaattactctagtgtgtgacttcagtcaagtaaattgcttaatcttccttggccttattttttacatattcagaataaatttgcattggataatttctaaggttctttacatttccaacattctatggttctgtaaaacatattatcaaatgagaaaatgttatgaaatctcttttttgttgagaaaagtgtttacttcagttttcattttatacttcagtttaatttaactatttacattgataaagttattttacactcagaaaaatatgtctatcggccaacagccgggacacagtgatcctggggctaaacacaatgaaggcatggcaacaacactgttttttaaaatgaatttgaggtggataaagtttagaaaactatttcaatattccaggtgaaagtaatacaaagcctgtagtgaagtagctattggcactagtggaaaggaatggatgtgaaaaattgtgaagacccattaagtttcttatttttttaagtcacgaatatgtatactttaaataaatttgatatttaagaagaaatacattccctattttaaatcagtaatatatcttatgacatgttgaacacaatcagtatgccatgtaaaccctgcagcactttactctaaagtcaaacttaagtgtttcacagtttgacagaatacatatactctggcagtaaaacatgtaacagtattttaaaagaatatttcccattgatttatgtatcacttttaaatacttcctttttatttaatctttttaacaaccatctagtacatattttacacaaatgaggaaactaagattaaaggaacttaagtagcattgcaaagttgttaagtagtagagctatgactcaaactgataagaattttattctatactacatgtttttccaattctccatgctctcaacaattctgaggaacatccattgtaattgcattcctaaaattaatgcccatgaatatgaaacatgaaaatatatcctgccccatatttccaaatggacagtttctaccagaattttgaagcaacttaaactatgaatgcctatgcaaaagaatttaaccagctctgaaggtataaaggctgtggaggatacagggaacacttaagatatcaggaagaggtaataaaaactgaatatgaacagatataggatataagcatcttcagtgaaggagtagtcatttatataacataattgctgtttttttgtgtgtcattgaagacagcacttgtatctagtttatttgacttgtttttcagtttaatactatgatgggcagaataatggctgcacaaagatgtccacatcctaatccccagaacctatgaatatattaccctataagggaaaaggtactttgtagatgtaactaaggtttagtaacttgagataaggatattatgctgggttagctgggtgggcccactctaatcacatgaaccctcaaaagcagagaatatatcctagctctggttagagtgaaatgtgactacctctgaattcagagaaatacaatgtgagaggagaattcaagccactatcataagctttaaagagagaggaaagggaccatgaaccaaggaaggtgtgtgatatttaaaatctagaaaaagcaagaaaattgaatgtcctctagaatctgcaggaaaaaaaaaatgcagccttgccaatactttgatctcaatccagtgagacctgtatctgacttcagatatctagaatagtaagataatgaatttgtattggttaaagctgctaaacttttggcaatttgttatagcagcaattgaatactaatatatgtattccacatgtatttagcctcctaaagtcatttttagcaaatatttttgtcaaataaagagacaggtggcatggtgtgttagaaatagtttttgcctcctccaatttagtaaacctaggacttagaaaactgacatggtttgaaagctgaacttggaaacagtaatataatattctcaccatttaattttactgaggacaatttatcttcatctccataataaatgatcatttgtaatgcaccatgatggctgattctaattcttccttttctacttcccatgggtgtttatctttgttacacttcaacgacagagttcccttaccaccaccctctgcatctcagcatattttttccccttgcaatgagagtatgaccaatgacccttcattttagctaatcatgaagaaacagactgaaccagagacagaatgagtaatccaggctcgttgtccttatattttctaaaataaattctactgtatttattctaatgtgtaatatacattagctcaaagaaaaacattctctaacatatagggattatcaatcattttaatgcaacttatagtttgaagaatatgagcaaattttaagggggaaaattgagggaataaagcagattaaggggaagacaatgcacatttatcagaatgatttgtaatcagaagtattagtctatcagtcaaaaccattcaataagtgttagaccaaacataagatatgggaataaggtaaccatgatagtaatttattatgaaaattggaacattttgagagataaattgggcaccgttaataatagttttgctagcatagaaggcaaataaggctatagttacattagtaatgttaaattcccaccttataaataagtattatatagtaatttacttatttataaaagtcagacatctatgtcaaacagcaatagtttaaatttatttgacaaaaacaaacaagcaaaaaacacttgccacatacctccaaactgatttcaatgcatcactactgaggatgaggattgaggcttctgaagattggtttaggagtcaggaggcttgagttctacctccctgctttgttatctttggctgcagaggtccacattaaattttcttcatatataaaaagagagatttgttcatatttaagttctatttgagtattgatatgtttctgtagaaatcaatatcaggagatctcatgtgattcttatacttattgcctgggctctggttttctataagggtggttcccctcccttgagatatctggatatctattagggtgatattcattgttctgataattggaggtggcattactggcagtgggtgacactaggaatgcccaatggctttaatgcttgagtcataaacaacaaattgtgttccttttcttcagaactctaaatgtttcacaggacatcaatgtacatgaaatatctgtttataatttttgaactaagaaataaactccattttattttataaatgcaaaataatttcacacagttcaaacataagtgaattttccaggaatgctactattgtgaaaattgtattgaaaatacactttatttcatttttacctggggctattcatcattttccaaatgcacatcactctccacaatgctgctcatgatatgacaacacacctgagtcagcctgcacctgtagccatttatttacactgattctgcacatatgtgcaggcatccttccaatctggtgtagttttgcccaaacattgatactgaaaaacaacatattttaaaatatattactttgttatacttatattgctctttacagttatgtgtgtaggtaggttgcattatccatgaatttcattttaacagagtagagataagatgtatcttatataaaagggtattgagttggataggatagacaaccacagccttggggtacagaaaaagctcatagcatttcaatagtgagaagaacttttggattcagcctaccatagtggatagagcactggtctaaggcttgaaagcttgagttttaatttcagttctgccatgagtcaaattacttgtgcaaattgtagtttcctcataggtaagtttaaaaagccagccaagttacagtgcaggccatataatttttctgttctcttatgtcaaaataagtggctagaaaatacagggaaatggaacgtgaattcgcatatggagaaattctcaaataattagagctgtgccaaaatggaactggtgtacactgaaagtatttaagctgtgtctggttaattatttgctgtggctggtgtgttgggaggatactggattctataaaaggtgctcaacttgaggtcatcagtggagtataaatcaagaatgaggtggtatatagatgtttctatggtttcatgttgtctctggtatccattccagattaaaaacaaagggatgatctctcatattttctccagttaaaaagctattatctaccactgtatagagagttagctataaacttagagatactgttttacagacttactggaaataaataactcacaaagtagtatttaactcatatatctcatgtaattgtcaggcctagtgtttatccccaggtattctctaattgtctcagaaagtgtcctgatatttaaatttattttaaaattgtatgccatagtattctttaagaagaaattctatatatggaaactcagtagatacaggataattttctattctgaattaaaaatcaggactcactgatatgaacaagaattcaaaagagatgctattgcttatggagttcattcttcagccttgctcttcaattttaccactttttctctaagatggtcattctggtaattgtagccactcctgatcagctcagctcccaatgctgcccactctctatagttccatgacactgagtctccagggctattgactactctttattaagcatgtccacatatatatatatatacacacacatatgtatgtatatatacacatacatatgtatatatatatacacacacacacatatatgtacatacacctatatacatatatatgagtgtgtgtatatatatgtatgtgtatatatacacagacacacacacacattttaaaagaactacagctgctcaaggatttctagtgtgtgggtgacagcaaggttacattaaccatattacttgaatcttatttgttattagcccctgtttgtgtgataataggagttcagtccccatttcagagtgttgtgttcttttaagcgatttggggaatccctagggcatgacacacattctgccaagtgagtgtgagccactgctcacccctgacctgcttctccctcaacctctaatccctgttgctcagtttggctcattgcacctgatagttccctcacacagggaaaatgattggggtttggatggaggaggaattcttcaatctcccctggcaatttagtttctttgggtgtccatcccttctgtcagacattgctgtgatatcgcggtccagctatggatgtgactgcattatttatccaggagattcctcagccttcctgtaagtcgtgttgtaaatgtggcttgagcagtgctgcttagcatcactcagcagatacatccacgtctcagatcttccctgagccaagaccacacttgcacccttcccctggtcctaccatatgacttaccatggtgaagcatgggaaaaatgagctaagggttaaaccaatttaattttagaccagactttgtggctaattgtgtaaccttaaataaatatttttatccatgtgaacttagtctcttcatctacaaactatcagaggtgtggggtagattatctgtaagtatctttctacatgtaagagagcatcattttaggaataaacttatcaacaagcaggaaatttattcctctttctcattgtcctcaccccaaactagtagggagttttgtatattttaggatctttcatggtagggtggccaaagctcttaactgtgagtccgaaggcttcagtttgggttccagtccttctcacactgagttttctaacttcaaataaatcactcacttgcttaatttgcttatatataagagaatgctcttgaagatgctttacaactctattatttaaatgccaagatgagaagatatctcttagatattttttcttttgtttagcctcttaccttgtcaaagaatgtctccaaaggagatttgctcaggtgtcaaatctccactatttattgtcagcatgaaatcttccactgagtgggagaagataaattttgaattgtgagtgtgaattatgcttgcttagcaaggccttacttatctttttttggttgttttcctcatgtctctctatgatccactagggggtttgcattaagcttatgatgcccagcatgattgattgtatttccagtggctggacactttgctgggggctgtggttatgtcttagaaaatcacactaatcgaatttgaagacactgatgtgcattctcaagtaagagtctggctcttggggatttcatctaggtcaggctttataaattaagtgatggattttttttccttaagtcagtaaataaaattcatcagtggccttacattgccttcacacttctgcagttcagccaacctatgagtcaagtagcattttatccactttaaagctaatattttgtggtagttggcaatctatttattaaaggcagaagatggaaacacagggtaatttgagaacaacttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcctggctaattttttgtatttttagtagagacagggtttcaccgttttagccgggatggtctcgatctcctgacctcgtgatccgcccgcctcggcctcccaaagtgctgggattacaggcgtgagccaccgcgcccggcctgagaacaacttctgagatcactgaaaagctagagaaaaatgatcattaaatgtatttctcagaaattgttgaagaccatacgtttactgtcattcctttctgtataggaaacaatgcagaatttttcgaaggtctcagatcaaaggcagtttcaaaatagcaaaacaattgtaccgtttttattttacttcatttatttattcatctacttattttaaaatgtttactaaacacttattctgagccagaaagcatgcagggaatggaagcaggcacacctttaaaatctcagggtcttttttttttctccttaaggcaataaggatttgagaaaacaaagcaacagatattgagaatcaatctgtaagaaggataataatattagggtaaaaacttgatatctttatgtatgtttgctacacagtattactgggaagattgtaagaactatgataattaaaatgcatggtgcctggtttataacagatgcttatatatgttagtctcttttcactagtgggaaatgacactaaaaaatgtacagtcctttcagattagagtatttttaatgctatcggatagtgtctgtattattaattgctgtatcctagaacagggcttaatttgtttgtaatgagtgacaatgaatacgtaaacaagggagggtcattgaaggtatttttaaaatctgctgaagatgctgtagacagagatcttccattagaagtgttattgctctaggtgatctttacggaaaaaaaaaaatgtaaagctagagaatagggacagacaccaccaaaatgtgaagcatgatttatcaaggaatacaaaagcaaaactcagcaggacccctacgcttccattatcctatgaagaaatgtgtttagctggagcacaaatagataccaagtggaaagtgccacagaagacagaccctattacatcctgagttatgctcctatggagaatctaggggaggaccgaagagaatctggcctatactgtaataaaaggagctttctgctcagaaaaaaaagctagctttgagctttgagaactcacacaacagttgcctaggttagattttacagagctagagtgcttctagagtacataggggagagggaaagccacagggttatccagcaaatagagggattgtctcctcaatgtcattctttcttctttgaaactgttatggacttcttgatgctgctgggactcggaattcggtattaaaaagtagccttaggtttgtttctccttagtcactttgttaacgagtgtgtaaaaaacattaactactgtgagaaactgctatttataggaaatttcttgatgtaatctgagttttaacaaaagaaataggaaggagttcttaggaagtcactttgtgaggaaggagaaggcaaaacgggtgttgagaagaaatctacaggaaagatgactgtgttaaaggttcatattttttaaaaaagttgatgtccatattaagatagaaattcagaacagacagatgttggatggatgaacagacattaaggatggatttacctaggtctggagtacttacacatgtgagggatatatagatagtagtactctggaggagagaggattaggcttatacatacactttctgattctgcctcttaggtttacctttcttaaatgagactattctgtcattagctgctgcactaattttgggaagaatatataaaacgtggattggatactaatggattcccgctgcaggtagaatttgtcttaaattttgggagctacgctgccagtggaaacccaaggaaattagtgatatttccacattttgacataatagattcaggataatcttggacataatttgtttttcttggctagctaaagctaagaaaaacccaaatttctactgtcagacacattttctcttaattataagtgcttttatggaaagttaatttgtgtgggtataatttatttacatatatttacatttgactcattaaaatgttctttccaagagttgtttgcaactgtttgagcattttaagtcttgttgaaaaatgaaaatatgtcttttgccaattgagaataaatttagaagccccaaagtgtaggttgtagctgactaccttctactatggaaaaatattttatgctgactagtacacagccgccacataaaaacagcattccaaaggaaacaatcaatcccttctctcatagctgcacccacatcaaactttaaggaaattggtagattcaaggtgtaaataccgacatcacacaacaacttgtaaaacaaacaagcaaacaaaaaaagcaaaatgcgcattgcattttatttatgtttgtgaaggttcagtcactcaagaagcatttatcaaatacctactttgtacgagacatagtagttgctctaaagcaaccaacattttataaaccattatctttgctctcaacttattatcaactaaaaacctattagactctgatacaaatctatcccccctaacactcctgtgttatttttataattcctgtcatgagctgatagtagttgacaattgttccaccactacttatcactaggcacacaactaaatgatattatatgcatctatatggttttatacgtataattttattcaaagttacatggccattatttgtaatagatattattatacccatttaacagacctaagaaggagcctttgaaaaattcattaactttcccaagatctgtttcacttgaaggcttaactccttattattatcttcttttttttttttttttttttttgagatggagtctcgctccgatgcccaggctgaagtgcagtggcgcagtctccactcactgcaacctctgcctcccgggttcaagcaattctcctgtctcagccttccaagtagctagtgtttgaatggattaacatatctttaggagcactggtaattaaagttttgccctatagggatatgcattgtttccattcacaggtcaaaactcatcatccttctctcccttcccctacacactactaaggaaactacatgttagaggattgtaaacgacagtttttagtatcacctagaaaacccgttttcttataagaaaaaaaatgataggagagttctagtgaaagatacaaaaacaattcctcagttatagaagagaagctatagggtgcatgaaaccaagcatttagaagaaaagataaagtttaatttctttgtttggaatatcttaatagacagtcttatgtcactaggtgattttagcctatatccaaaaagatttagctgactgaattaagttaatcctttttattctggccacttgataatggtcaactaagaaatccaaataattaaaagggctttgtttttacctaaacccgcatataaaccacctcactggctcaatgaaaagtgaatattatgatctgggaataacaaaatcaatcctgataaattcattatctacatttttgactgaaactggattgagcagaaaaactgatcgttttcacccacactcttgacttctgaatcaaggatgatttaggctttaggagttagatctacaaacacagaatttgaaatgggccctagggaatgagaagaagctgtcactttccactagcgtaaaagaaatagtgttaggcaacattgttcttaagagactcaaataattttggctgccccaaagggtttcagttctttgtagttttatctacttatttctcagtgatgatatttattgaaataaattcatgatcctaagtcaaaagaatatctgcagtctgtggctatgttgatctttctttgttttcactagactttttcattatgttttaaatcttgatgtgtaatattgtagaagaaaaccagattacatatcactctaagcctatgactgttccaaatggaactactctaacattgttgacttactggaaagaaagtgtttttaataataaagcaaacagttacctgtctggttaacatttatcagtggcgctgagtcattttatcacttgatcattctattttgttttttaagaaaggaatggtcaataaaaaagtacaaattttaagccggtgcggtggctcacgcctgtaatcccagcactttgggaggccaaggcaggcagatcacctgaggtcgggagtttgagaccagcctgaccaatatggagaaaccctgtctctactaaaaatacaaaattagccagacgtggtggcgggcatttgtaattcccagttactcaggaggctgaggcaggaaaatcgcttgaacctgggaggcggaggttgcagtgagccaagatcctgccattgcttgccagcctgggcaacaagagcaaaactctgtctcaaaaaaaaaaaaaaaaaaaaaaaaaaagtacaaattttagtaaaagtgaaaataaaggtatctcttaagaaattaagcctcctattaaccttgacttagccaatcatgctacctataagcagtaagaaaacataaataaaggccgggcatggtggctcatgcctgtaattctagcactttgaggggccgaggtgggtggaatgtgtgagctcaggagtttaagagaggcctgggcaaaatggtgtaaccccatctctactaaaatacaaaaaccaaaaaaaattagccggtcatggtggtgtgcgcctgtagtcccagctactcgggaggctgaggcaggagaattgcttaaacccaggaggcggaggttgcagtgagccgagatgatgccactgaactccagcctggtgaaagagcgacactacatctcaacaaaaaaaaaaagaaaaagaaaaagaagaaaatatgaataaaacaatgtaattttgtcataattacagaagaacacattgcttgctacaacaaatactgatacggaaatgttccttcatataacagtcagaatagtcatattaatgttgtggtaacaaacagcctctaattttagtggcttaaataacatgggctaacttttggttcaccttggcttcctactatgggtgaatgggaaactgtaattgtaacaactcagtgatctagactggtagagtagtgacgtgcttgaaaattgctggtctccaggccagaaagaaaaaagatagtcttgcactggtaattaaatttttgccctatagtgatatgcattgtttccattcacaagttgtttgtgaaaactcatcatccttctctccctacccctacacactactaaggaaactagaggggaaatcacacaaatgatcttcaagagacagaagtttgtggatagaaaatgtagacattgaactgacaactaacacaaacctaatgtacaatttacctaatatacaattgaggaatgataataagtactttaattgagaaagggaaagattgggaggcacacagagattttacttttctgctgaatataaagcccaactgattaaaaattttaagatctcttatcttggggatgaaggatgctgcttgctttgttttttaatcagtcccaagttcaatattctttatgactctcagctccgtgctctgggggtttcctttttctctgttattctccttggccatattcacaagagtgatggagaataaacctttgtttggtgactgagcagtgttctcagcctgattcctgccagtagaagtgtacaagcccataaagaatgacattcttttatttgcaacaatatggatagaactggaggtcattatactaagtgaaataagacaggcacagaaagtcatttcagattttaagcagttgcagtctcttgtaatccaaactgatggtccttttaaccagaataaccacaagagcatggtcttagagaactagggaaatgggtactatttgtggtgtgcttgtgagctagagtcaggaactaagcagagatttagaacttgagctaagttcagtaggattccactgtcagtaaggcctttgagccaagtaatcttagccacaataggaaccaagcttagcgtgaaaagaccgtagtcctctctgcctggtgtttttaaggatacgaaagcggtagctgcctacatcataactgggttaaaggacacacagggctgagtctgtaagtttaagcaagaaattgaagaattcaagaaggcagtgactgacagtgctttgtcccagattacataaagagttgatgagaacaaaggagatctcttgattttgggactataatttagcttgggcaaattctccaccatgctcttcaaagatgtttaaaaaagagacaacaatgcaaagaaagcaaaatagaaaattttaatttgcttaactctttcataatgttttcaagtcaccctaaatatgagggaatggagtccctgtgggttccagtgttttgcccaggcaggtcatatcacaagaagacgatatgcctgactcccctgcctgccaagatagcacattcacccactgtgctgcctatcccaattttaattaaatgcacatatgttcttgttttgcttttgttctttctgtctaaactcatcattcccaagttttgatcctacttattactccaaaatgtcctcagaatggcataactctaaaatattctattatgggttttgaactcaaaattatctatgtttgaattcaaatctacttaggcaaaatattcacgatttcgcatgcatttttctcaaatagagataatactgctgataggtaataagaataccacagaggggaaggggctctactgtttaggggagaatggtatcagggcaatagtctgcttccttttttcacatcttactccattaatggagaagcaagagtgggtaagttttctctctcttttgattggagaaagaagatttaattttcaaaattagcttcttctgctttttttttccttcatttgatttgacctgctccttacatgcagattttcatctctttaccaagcaagtcaaaagaaactccagtctatattcctgcagtgaagagatggggtggaaaacaagggggaaactgcagttgatcaattattgtgacctggtgggtaacatgtgtccagagaaaagaagaaaaaggccatattgttgttgggcccagtttggatgctaagatcttcccctgccctcctttgcaaatttgatattttgatgattatttgcttcttaaatcttaaaagatgcaaaatatgtaacataaaacttgctacaaagttagtgttcaataattatatactattttattatacatatatatttgacatttgtgtataacttatatgtatatatgcgtataacatatatataatatatgtatgtatagtttgtgtataacttttccactaatgttaatgctatttgctttttgtaagaaattgcagggagaaggcagaaatagcatataaaaccttgttagtttattacctgtgatgcaaatttctctttagacaaatttctctttgtttctaaaacttctacattttcttctgtaaggtaagtagggctggtcatgactgcctcagagttagtgtaagttaaaactaatcgataagccagagcaatattgattcaggtattctataaatgattccttgttatgattcttaaatctagaattgtattaattaagaatatggattgcaaattaaagaaactaactcaagctagctaccaaaaaaaaaaaaaaatgttttttagaagcctcctgattatctcattaaattcaaggaaacactggaaaaccatgcctcaggatggtagtaaccctgggaacaactgaagaaataaacttttatttcaagctctgccatagtgtaacccactaaccccaactagtcagactagcaggtcaaattctcttttttgaatcttattatcataactcgaattatgtatcaggcatgagtcagccagaccctgtggcttataggttaggcagacacttcccaagttgttttccataagtcttcaaaaagaaattatttgaaaatactataagaagataattatggagaatattattaatggattccttatgttgctcaatttgccttgtatgaagatcacagtgtcaaattcctcttaatgcttaggttgaagaaaaaccttacttcttctgaataaatgcattgcttttcaagtagaaaatgtgacctacatatcagatcttatctctctttgcctttgtttctccaaagctcagaacaaaatcttattctctcattttcttctatccctcttcaatcagaatttttgaaaattccataccacttttgtttcttcttatttctaataataaatgatcttactatactacctccatgtttaaggtgtctcaaatgtgttttggagtggatgtcatttaaacgaataaagatcattcaaataacaaaattttgagaaacgaatagtatactttagatttatagatatgctaagttaatgagttatatttatttaccattatttctttgtaacctacacaaagtcagctaaatttgaacattaatcctaccttcatagcatattggtaataaagaactcatgttcttataggcccaaatatcagtgtatgtcctttatttgctagtcttcactctagtcccttatattctttttgattaagatcattgatctagctattgaatctcagtgttcttctctgtttggtattggggattgaaatttagtatattggtcaagagaatggactatacagtttgcctgatttaaattcaaattctggttactagctatgtcactttgggagagttatctaaatttcactttatgtatctgtaaatatgggatgctaatacccactcaatcaggttgtcatagagattaaaataaaatgtcttataaaagctcatagcagggcataaagcaggagctaagtaattggcagtgatcattattattactatggcggtgatttaactacctttctgcaggttattgaatttccagttattttggtgatttctaaggcgttattgctcttgccatcaatccttattggttcatttaacttctgcatgttttgttgtactgctgtttactgtttcatttttcattgcttagaatcctatgctgtatgttctcatacttttcattttattataacgttcaaatatttatcacgtttagaatatgtaccacacgtgtttttctcagacaaatataagctccacaaggaaagagaccacatcagttgttttctctgtatcatcacccatgcatagcatagtgcctgcagcacagtagggattcaacaaatttttattgatgtcaatcatatttctgtcatttttttttctactctgcactttgcacatcccttgccttgccttctcgtggatggtttttatagctcttgcttctttaagtctactgtttttctactctctctctctctttttttcttttttttttgagacagcagttcgatcttgttgtccaggctggagtgcaatggtgtgatcttggctcaccgcaacctctgcctcccgagttcaagcgattctctggcctcagcctcccgagtagctgggattacaggcatgtgccaccacgcccagctcattttgtatttttagtagagacagggtttctccatgttggtcaggctggtctcaagctcccgacctcaggtgaaccatccgcctctgcctctcaaagtgctgggattgcaggcgagagccagtgcacccggcctgtttgtctactctctttgtgtgctgtaattgcattcctttgttctgaaattcttggttattgttataaatttttgcagaagtggtcccacaggaaactctgtcatttgggtgggaaaataccaaatttctacagtgccattaggataggagtcatctccaaaaaacaaaccaacaaaaaaaaccatttatcttggatgcctactctcctgtcactttaaaaatttttccaagcagcagccccaaagaaagaacattcaagactataggctgagtcagaactggagattcagctctttcatttataaccctttgctgcccactgtatgaatttacagtggcacattatcatcttaactgccttttaatggtaatggtgatgtcctgcaaattgagaaaaaagacgttgactgtgaattcctaggagattataggcccaataactactgttattagttccaggatgattgccaataatgcagcatcacttaggctccattatttgcaatcttaagggctttaagaatcatctaaattccctaaaccgttatctttaacttagaccggactacgatgctgataagcacaactggggttcagtcattagatatctaaattgggaaattattgtctttttagtaaaatgcccttttagaaaataagttagaaagggtttctaagggttaattagtggtaggaaaataaatgctactcctttcttcccacccccagcaggttcgtaagctatttctatataagcaagactgaaggagcttcagcatgctatctactaatgaccttaacattaaacttcggaagccacatggacactcttacatatagagtggagagatttctgtccactctagggattgtttcaagcttagttcatattaaagcatcagtgtgaacacaaccagcatcttttggttattctaatgggagactttgtagttctgtttcggctagaggacaacaatccatatatgtttgaaatgaagccattaactattcagagaggaaatatctgaaaattaaaaattcaggttttctataatagcttctaggattttttgatgtataaaagtggtactggggcatactggaaagaatatggttttgaaattagatacatctgtttagatatttctagatgtaaggccttaggcacatcaacctctctaaggacaatatttatcttcccacattgttaggagtaagtaaggtaatttatgcaaagattttcagaacttggaaatgtagaacaagaaacaaaaatcaacagaaaaaaggaaaaggcgagtgtaggtgagggcttggaggtaggctttgcagagactttgggagttctgatgcataggagcaatattagtatgaaaaaaaaaaattggaaacaaaaaagacaatttaaagaagcatcactgtgggttgcaagctcccttcattgtactttgaaaaatgcaactaaagatcttaaattgtttggaatttcttttatttctaaactgtgttcctagagtgagatgttgtcttgaggctggagcattgagatcaatataaattcttacatcagcataactgcttctctctcccctgccccacatattggttggtttcaccagattccaaagtagaggaaacagccatggtagaaagacactggtttgatttcataagatctcagtttaaagtgcttaatctcactttctcacttaacacttaaaaatattatttaatctcctgatttttattgtctattctataagttaagaataataatacctcacttcgttgttatagtgattaggtgaactcatgcataaaaacatacagcatggaaacaagttttatattatttgataatattggtgttgttaaattcaatcaagaaataaggcaccagaggaatagattaagagcagccctttcaactcttccttgctgttgttggggcagggtggggggttgggttgctactccagagaataatttgaaagggactctcttttcccatcttgtgtttctattgtattatttgtctcttttgctttatacaacttttttttttaagtatctattcttagttcccctccttcttagggacatgaggtgtaaagaatgtactaaaaatgaaagtaagggccggacacggtggctcatgcctataatcccaacactttgggaggccaaggtgggtggaagacccgaggtaaggagtccaagaccagcctggccaacataatgaaaccccatctctactaaaaaaaaaaaaaaatcagccgggtgtagttggggggtgactgtaatcccagctacttgggaagctgaggcaggagaattgcttgaacccaggaggtggaggctgcagtgacctgagatcatgccattgcactccagcctggatgacaagagtgagactctatctcaaagaaagaaagcaagaaagagagagagagagagagagagagagagaaagagagagagagagagagagagaaagaaagaaagaaagaaagaaagaaagacagccacactttgacaattttgttcagatccagaacaatatattctcctttcatcaatctccatctattttatatgtatccacaattatgtgatatgtgctacaaaatcggagctgtttttttcattggttctctttataacagcatagcctgtttaatgttctatgaaaataaagacatttattaaaaatgctcagtaattgtaagttagttgccatattaatataatataaaacatgtctgagggttgctaaagataaatgttttccaagggaagaaattcagttgtaagaatctgctgaccccagtactctactctgaactgagaattgtaaagccagctctacaaaccagttatctatcattgggcctatcttcaggcagagtgattattctacctgagcctacatttccttatctattgactaaatggtatcataatctgctctagatgtcactaattgagaagacaaactcataattgccatgtttagggaaagcagaggaagcaaatagagaagaaccaagattttaaatctgaaaccagcactaaaaaggtaacacactaaggataacattagcaggggtccagagatgattgagatgcatttatagtgttgtgatcatgtggtatagtcttgggaaaaattaagagggacaaggttttgacagcagcttggactatctgaaggcttgacttgcttaaacttatgagtgcccctttcaccacaaatacgagtctgatttttcaccccagagtctgataaattaatttttgtgctattttttttcactttacaagtgcagtgagtctgaaaaaaaagataaactaattgatatttctaatttggaagatagtttgatgacaacatacagtgaatctgagtgaaagatatcagcaacagttaaatgattgccaaaaacaaatgttttggaggtcaaagagttgttgctttagttgtttcttgactctgaaagaaaaatttaactagaagtagcctccaagagtgagtgattatcaatttggctataccaatttaaatgtaaatctcattcaaagatacccttacaaaaacaaacagaatggtcccagccaaggtgacacataattcaaacactggttggaaggtatgtcaaacaatctcatatatcggtattatatatgcaatatgtaatataatataatctataatgtacaatatatcacattacaatgcattaatctcagttttatctctttctgtccatatctatctatctacttacatattgtcagtcaaccaatctcaaaaaatataacaactaatcaggtgccaaccataatcttgagacacaggcttgaagaacataaacctaaatgtctgaaatcttaaaagatcaagtttaagtctaaaatcctgaaaataacaatttccaaagattaaaattcccaagtgttgaaatcctgaaagccaaacactggagaagggattagtgcatttttagttggatgcaagatagttgcatcatattagtagtactatgccaatcagaactatttccttgctactgtctcatatttggaaattaaatatgttttaatgagatgcatatgggtgccaggttgacaaagggtgaacttgtggccttaattttagatgtcaatgtgactggattaaggaatacgtagaaacctggtaaagcattattttggatatatctatgagaatgtttccagagattagtgtgtgtgtctgagtagtctaggtggggaatgtctgccctcaatgttggcaggcaccatccaattagccaggtgcctggagaaaacaaataaagaagatgagctgatctctctgagaactgacagagacttgacttctgctgccttggatatcagaactctaggttcaccagcctttggactccagaacttaacactagtggccctctggttccagaggtatttagtcttagactaagagttacacctttcacttccctggctcttaggagtttgggggactgagctgcactaccagacccatcccacgttctccagcttgcaggtggcctgtcatgggacttcttagcctccataatcacatgagccaattcccctaataaattgcttcatatatcattatacgtatcctattgtttccatttctctgaagaacgctgacttatacagatctgatactgaggaagccaaatataatttctttttctgtattccctacaatagggcatctattcctacagtagaaactgttccctcaaaaaaaaaaaaaggctgtgatgttaagtttatgaggctacttagataaatgtttaaaagctaattattattggtgctgcaaaagcaggaaattgcttaattgcaatggccaagcaaaaaccagacttacagttggacagcatatacttgcaaaatttggagaccacaaccactcttcaattacaaatgcagtgagtgtttcaaagatcatagaagagaaaatgtaggtgaaaaatccaaaaactacccctcccctgccaaactgttcaattatgcaaacttctgccccttcacatatcgcaccaatttgctatgtattacatcttcatattagttccaatcctgcaggtatgaattatgtaaagacttttagagttcttacttgttttatgcattttttgcaaatttggttgcacaaaagtgcattttcatgatatcgactttgtggctaagcattgtgtgtgtacataaaaatgttgaaacttcctcagtaaattaagagatgtcctttttgaacatcttcatttgtgaaatataaaacttcttgagatctcagctccttgggtgacttcatatgtggtggtgacccactgtggtttttgattgatcctgtcaaaaaaattggattgtctttcacagtatttcagatgaccaaaaatataaagctgagtgcatacaattaccaaccgcagtgatatgcatttacacatattactttttggcctgtttctctatgagtatagtttgtctcctcacaactgttataatcatgtgactgttgttagtatacctgagtgcttatgcttgccaaaaataatattatcacctattttactgtgtaaagtggcctatgacatattctgtcatgtttttatctgtttcccaaataaattccttttagaaatgtaattaaatgtgtttctttacatatatgatccattttatttcattgttttcttcttgtttaatcagtacataaacttgtacatatttttggggtgcatgtgatagttggatacacatatacaatgtgtagtgatcaaatcaggatatatagggtatccattgcttcaaatatttatcatttctttgagaacatttcaaaccttatcttttaactcttttgaaatatagaataagttattgttaactatagtcactttatcatgctgtcgaacactgaaactttttccttctacctatatgttgtacccattaaccaacctctcttcaacttccacccccactttttgtagcccttggtaaccatcattctacactctaccagcaagtgatcaactttttaatcttccacatatgagtgagaacatgtgatatttgaccttctctgtcaggctttacataaatgtctttttaaaatgtttttaaattaatttttccagaatcatatttttgggacttttatctttcaagattgtgattttggggattttagactttagggattttgatcttttagaatttcaatatttgggatgatggtattcgagactgtcttttaggattatgacccaaacctatacacaaacatatctcacatatacatatataatcaaatattaaatgtttatttgtgtgtaaagaataatatatagtgtgattttgtattttttttttatttctttgactagtaattggtgaaatctgtaaccaagtattatggatctcattaaattctggttttgtgttgttttgggaggaggcaatcctctaattttttttcagtacctccgtgctccacattgaaatgatttccccccctttatatcaaggtttaaattcagacattataccgtaatgggctgtggacttaaatctgtttgcaaagcctggctttaaccagtgctgtcctgaagctggtttgccctggcttggatgaggagagtgtatgcatcttttcctgtgttcagagacatcgtatttgttggtggcttgaaactggccttcatggggttacttacaacacagaaactggcaaatgctacgaagcagggttttgtttctgtttttggttattgttgttgttgctgttgtttgttttttccttcaaaggagccagctcttaagcatttactataataccactggtcttaatgtttttaaatgatgtaatcttggacatgtaaccattctattacctgtttttttgcattggaaatgaggaaaattataattctttcttcttccttctccttcttcttgtccttcttctgcttctctttttctagtaagagaacatatattgcagtgacttgtattaaaagtgcttaataaatgctttcttccattaattgcggagaattctcagtttatgtatttagttatttaaagctaacactaagacttcatcactctatgtgcctttcatttctgttgtctgcctctaatttcctgcctcctagactcatgcagtgctggaacttaaagatcttctgtttttatcaatagaatctttctacattacaaaaattcaagtattaaaattcagatgttaattaacatttatttattactatcatttgacttcccatttaagttttacctcttctcttaataatatcctttataacaaaaagacacacgtttagtttttattacactttacttcctttaaatctggagtactttctcaaactttccttaatttttatgaccctgctgattttgaagattacagaccatctgtattatagaatatgccacaatttggatttttgatgtatcctaataaactatatttaaattatgtttttgacaagaatatcaaataagtaatgccatattcttctcatgccatcaagtggaatatatttttgatgtatctcattatgaataatattcattttgattaccagattaaggtgggatatgacagatttttccactgtaaatttacttgtttgccctttgtgattattatttttttaactttcatttaaacctcaggggtacatgtgtaggtatgttataaactcatgtcatgggggtttgttgtacagattattttgtcacccaggtattgagtcttgtactcagtagttattttcccttatcctctccctcatcccaccctccaccctcaggtaggttccagtgtctgttgttcccctccatgcatccacgtgttgtcatcattgagctcccacttataagtgagaacatgtggtacttttctgttcttgcattagtttgctcaggttaatggcttccagtttcatccatgttcctgcaaaggacatgatctcattcttttttagggctgcatagtattccacggtatatacatacctatatatatacaccacattttctttaatcagtctaccactgatgggcatttaggttaattccatgtctttgcttttgtgaatagtgctgcagtgaacatatgtgtgcatgtgtttttatgacagaatgatttgtattcccttgggtatatgcccagtaacaggattgctgggttgactggtagttctgtttttagctctttgaggaagtgccacacttcttttcacaatggttgaattaatttataccatttacatttttatatcactatggtctcataggatacaagtttattcaatggttataatctgtaactattaatgtttatactcaaattgttccagatttgttttgtaggagtgtcttcagtctcagttgtgtgtccttttgccctgccctcatcactcttcaagtatttctcctcacaatctaatatttgtctgctcccactgtggtatcagctatttttccaggaatccatgctttcttattgtggagaatagctttagcaatcaagatctgggaagcaggtatgcttatggttttgtaggtgttgctgattgaccctctcagtagataggcctgggaaatacttcatctttatatgtagatatttacatatctaactataaacatatttatttttctatatatatctttacatagttctatctctgcatgttttaaaccatgagttgactccaatatctgcaatttaaatccaacacaacgggattaattctcattttctcccttttttgacaatgagaaacttgattcccattatccttaatattgttgtttacttgatccagttttcattttggttacatattcaagcaattattgtaactgccattgccactgcttcatccacgtcaccttacacctaaatgctccctcaccttgcttaagcgctggcactctgcgccaaagccttacattacctctccacttgagtgaacactctccttacctcattcatgctctgaacatcaggctgcttgcactattgccctttgagtgggaatgctcaccacttgcttgggctctgaaaacccaccttagggtgcccttctgtaaggatacccactcacttttctcttcagagctctgtaccacagacgtcatagtcatccctcttgggttccagcatcccaggctaggctactgtgacctccctaggatgtgggtgcctactttccttggatccactgaatggcctttggactgcaacggaggggagagaagagaagagaatgaaagggaagagggaagaagaagagggggagatgtacaaattcttaagaaaatctgtatcagaattagaattcaaagaatggcgatactccttgatttctgattatttagcattttgtttttgtcttggtgtgcatagagctagttgagggatttggaactatgggtaaagtaaatctggcagccaaaattaaggcctgttaacgaaatgcttactgatataggtggcactctaaccccatgctaaaagatgtcaaaattaagaatttattggataaagtcttttctgaaaacaattttcttggtcactataattggtaaaatgtcaaccagtcaatagtctgggaacaaagttagatgtacagatgaatctctatacagatagagtgaggcaaggttctagctctcttggagctgggttatgggggccctggctaacatgaaatccgtggtgctcttttagctacagcctgtggtagaaactaggtcaaatattcagcccagctcaaatttccctgttagtcttaggaaggacaacattagtactaaatgacttagactccctgaccacagctaatccagcaggagtttacctttggcttgaaagtgcccaattagcttcttttcccaggaatttggatctgaggcgcagttactctggtcattctttttagaacacttaagcaagctgtggttgacatagccagtggttcctcataagaaagtagatcagaaaaagctgttatatagaaagaaagacaataaagtagaaacatttagagaaaagcagaaaaataagaccctttagctcctgagagttgctactttagttccagctaattttaaattcctaatttgctctctttttctggggttcattgagattttcctgcaattttccaacaactccttctctccctgccatttaactttgttggtataactttatttctcttccatgcaaccagataattcccagctaagaaaatcttctcaggcatgggtaagacctgagccatgcttgaaaggaggccacattcatgatggtcaaacagcactattacttatagcagttccattctgtttcttttatgcatggagaattatttcaagagaagcatgagaaagctagaagcctgctagtgctggaaggagtgattcctcctccctcttctaccatgcttgaagctctgtctaatattttagctgttcctctaaagataaatgtcctagtaatgaagcatgcctttcaaattttattatttgaggtatttttgtaaatattcttcagcttctcttccatttcccttgtttcaattaaaaagctttaatgaaaaagtcttattaaaattcttattaaacaatggtttaataaattaatcatttatataattcttttagggtgcacttgaatttgaatataataaatgcttattaacagtaaaaatatatgagaataaaagcaagggtaaaatagtgtattttcagctccccatgtcttttctgtgtttaatatgcaggattgccacaacattttaagcttgatctccattattgagtgttttcttaatttcacaaacatgttcgctctgaaacaaatgaaactgtaattccttgtcagatgtagcattttgacagtttcaaagatatttgtaattatgtacatttcaataatattggaagtgggatctttgtttagtcctatgtattatttcagctacttaggtaattatggtaaagtactagactgtaattgaaataagacaagagtaatatgaacagcagcacaaaaatctattatgctgtggtgtgtaaggtatttcgtgttcattttaataagtcataactttgtcaacttggtgaatttgttcttgagggaaagattaagccaggttttaaaaataatttccagatatcacttaatgggaaggatgtgctatggaggtgctgatatttaggtgtttggggatttaaaatagaaatgctagagatccatcccaacatagagtttgcagagcaggggtagtccagtagaactcctgcattttactctatcttttctcttaagatgggttaaataaagggaaaaagaatctcattttcaaagaagaagagctgggacaggacaatattgtggaggaataatgcttttcccttgtactttccctgggtcttcaggaaaaatgatggaactgggtttatcttttattaaaatttggagttatatccaagatgaggagccctgtatgccattccttgactggagtgttttgactgagaggagatgcagatccatttcaaatatataacaccaaggaggaaaaatgccagagggatgatgtaggggcatagcatatgggaatagaagaagaaaactttttctctgtctccctttttctccctcattccctgtcatttctctttgacaagaaaaaggatatcaccaatccttatatatctccaaatggggctttggatagaagatggggcttattagtcttatcaaagtccaccttagtgaagagcaaatagacattttcattggaagaatgcagacatagggctaggagttggagtgggaagctaccagatgaaagtggcactgtatttttcattagaagaatgcagaaaagggctcccagatggaagtggcactgtatcttctcacattgatgcctgaaatccttgtgccccaatggactgtatctgatgtatttagacctattggatttttacctgcccatactgattccatagacaagactatgagttggactatcatcacaagctaacagaaaagcaagtagagtacactctccccaccaagaatgtgtgtcaaatatcacactttactctccctttccttatcaatactagtaaatccaagaaaaaaacagtaagaaggattagatctttcccttccttagtgatctcaaaagtcattcacagcagatgtttgcaatttcttcctgatagaaactcaaaaatgactacaagaaatagtgaagttattactaactgcaagcttaaaaatgcatgtattataaaggtttgtaggatctcagcaaaaaagtaatattatgtattaagagaaataaaaccagtacatgtttgtgcatggccaagttgatacttttgattttacctgtgaaattagttttgagtcagccatgatttaaatgtgtttcccaaaaagcatgtgttggaagctccacccacattcatgagggtggagtcctcatgacccaaacacctcctattagcccccatctctcaatgcagcagtattgagaggtggggcgtaatgggaggtgtttttttttatcatgatgaatccaccctcatgaatatattgatgctaatcgctaaagagcttgaggcttttttttttttttttttttttttttgagatggagtctcgccctgttgcccaggccggagtgcagtggcatgatctcagctcactgcaacctccacctcccagattcaagcgattctcctgccccagcctcctgagtagctgggattacagatgcgtgccaccatgcccggctaatttttgtatttttagtagagacggggtttcgccatgttggtcaggctggtctcaaactcttgacctagtgatctgcccacctcggcctcccaaagttctgggattacaggcatgagccactgctcctggccaagagtttgaggccttaagttcgagctcttgctcctctttgacctttcttacccttttgccacaggatgacacagccagaagggccttgtgagattttggcccctggatcttgaaattccaatcaccagaaccaggaaccaaaatatgtctgttcattataaattacccagtctcagatattctgttttgggagcacaaaagggacaaagacagaaaagaagtacggtgaagtgagtaaaagtaatcttagagatgacttaaatgtttgtgatcagaatgttggtagaaatttggatagtaaaggccactctgatgaggtctcagacagaaaaaagaaacaggtattggaaactggattaaagaccatccttattacattgtggcaaagagcttgactgaattgtgtccatgcccgggggctttatgggaggcaggatttgagagcaatgaactaaaatattcagtggggaaatttctaaggaacatattgaagatgctgcatggcgtcttttaactgcatgcagtaaaattgagagaggaagaaatgatttaaaaatagactttataattaaaagaaagcagaatttagagacgtgaagaattattagcctggctatgtggtagagaatgaaagagcattttcaagagtggaagctaagcacatggctaagcaactgattgacaaagagattagtatggatggaacaaaaccagaggcttttaattaattaggagaatgatcctataagtacattagcgattacaggtgcctctcctgtcatcagaggtataaagtgcccaggcctagggaaggaaatatgtcaaaagataggcctagggtctcctggagagctggtgttcagtgctcaagggtgcctcccgtcttctccctgcattttagttcggtactacttagtggctccagatgtggcttaatgggacttaggtatggctcaggccatacctaaggcacaagtagcagagatttatcacatgtggtgaggccattacagagaatcctcactaaaggtatcaccccgaagaccccagaactgtagtgctaccagtgtttaacaccagcctgggagagccgctacatgagctacaccaaataaagtcacaagggcagggctgcctgagttcttgaatgccaaatccccaccctggtgtgcccagaatatgggacatgaatttaagaaagattattctgagccttaaaatttagtatttttcttattgggatttaaacttactagggaccagttatcccttttttcttgcccgtttctcactttgggaacaggaatgtcagtcctatgcgtgctccaccattgtattttggaagtagatagccttttttaacaggctcacagttggagggaaatttggcttaggataaatttcacttgagtttctctcacatctgattctaatgagactctggacttcagacttttgagctgatacaggaacgagttatgacttttgggactatgggacggaatgaatgtattgtgctcatgagcagaacatgaatttggggaaccaggagcatcattatattatttgaatatgtttcccaaaagttatgtgtcagaaacttaattcctaactcaacattttgggatttaggaccttttgggaggtatttaggtcatgagggcagagcccttataaattgattaaccctgctatgaaaagagatgtgagagtgggtttgcttactcttgtccttttatcttccaccatgtgtagaagaagcaaggccctgaccagatgctacctctttgaccttggactttccagggtccagaactgtgagaaataaatttaggtttttcataagttactcaatgtgtgttattgtgttatggtagcacaatatagagtaagacatacacacaaacaagttataaaatagaaagaattttaaatctattgctttgattcatatttattttcttatctacagtgccacagagtgtttattcctacatgtcccacaggagaccatcagtgctttgaatcatccttagcggaaatcttggtatattgtttgctcggtaatttgttgtggctcttttgataaaaaggagaactttttaggattacttctgatgtgttttattttcttctcttcataactcaaaaggaacacatgaacagcggttgaaagaatatcccaattatattgtgtttagagcatctgcagagttggtcctggaggcttgggtgagggaaaccacagctgtgaagctttgctcctgctcctagcacagatgccaaagcagatggaagggcagggatcatctgcagaaagacttcagatctccaacatgagtaaagagtgaaaagcatagcgggcattgctgaaatggctagattgataggctctacactcccaggagcagcagaggcaacaaactctccccactctgtgcctcagacagaaacatgatgaatggtgtgtgtgtagtcatcttcaatccttttacagcttgtgcttctttattccaacaggccctcatttggtgctttgcctggaaattgttctgatgctgtttatgtttcaaatgcttagaaaaacagttctattaaggttgtatgccaaaacacaggctagtctgaataacaggaaggatggagtaaatttgggtctgctaatctgcaaaagaaaatattaaatatgctctctctggagaacagtaacaaacactttgcatgtggctgtgctaaatttactgcaggaactataagtgttaaaatgccagccgtgtaaatgggccatggggtggtaaaaggttgacaggatgattatgcttgaggggccactgttacgtatgtccttcggacagtagtttggaagagcttcagagacactaattaattctgccccacagtgaggggtggtaaccagtagcccagtgggaggctgagctatagagctctgtctgaggttagaggaccaggaaaacacttcagggtctgtctaagttgattctcaagagaaaagctctttaatcttatttaaggttacaaagtctttggcctcatgcaaaacatttcatcttgtgcaattttcagctgttcttatcatctgaataaagtaataggataaatcaagcaactcaaaaagatgagtagaatttcattcttttaaaatgctaattatagcctaagaatatcaattctcagcctcttctaatcaccaaatctctttcttgaatacaatttagattcctctattgaatttcttatggctccaatcatagaactcattggatttttcccctgaaatccctaaacagggatagcctagattcctgggaggagtaatggaaaactctgactttctgtgcagaattcagatattttttgactcatgatggaatttcatcccaataaacccatgataaattaaaaatattttaagttaaaatgcatttaatatacctaatgcagtgaacatcatacttaaccaaccttaaatatgttcagaacacttatattagcctatggctgggcaaaatcatctaacaaaaagcctatttcataatgaaatactgaatctcttaagtaatttatttaatgctatactaaaaatgaaaaacaaaatggttgtatgggtacttgaagtaaggattctattgactgtgtattgttttcccactatcataaagtcaaaaaattgttagttgaactatcattagttggggactctctgtagtgccatccacaagctaaactggacacacagaactttagaatagcatagctttgcagtaggcgagtttttggttaagaattttatcctatattttatttattgtttcagatataatttaattaacagttatttgtacttttcttgtaacatttaatgaagagagttaatatttattgagtatttactttgtccaggcaatgtactactatatataaattatctgatttatttctcccttgactattagcaataggtatgagttttataggtaataaaatttatgtaagatatacttatataattaagatatagtactgtagcatgtcgtgcagtgttctggcataaagttacgctggatatagttgggtaacaattatagtaataatctattacttgatacagtggtggggttttatgacaatagaattgttgctactcaagccttttcattttacctataatgtttttgaggcagtgagataattaggggtgaggggagagaaaggaacaataaaaggaaagaagaaagaagagaatagggagggaggaagaactgagtactaattaaataaaacaaaaaaattctgaagaatgaataatgcatatctggtggaacataatttataaagtaatgattaacagaacaataggacaaaggattgtttatcattaaaatgtactgtaaattaacctttacaaatacatttccactatgtacttttcgactgatttatagtatcctgtcttcaataatttgaaaagtgctaaaactctttatttgaaatgtaagtaaactgatctaaattatgattttatccatattttctataatataggtaaatgttttaaagtctctgtagtctgatgaatgaaattttgatgtaatagcattgtactgatttagtctctccgtaaatttggactgaacatttaaccatactgtgacaaaattatttttttctgtaaatgacagaaggtggttagaataatcttcttttaaccatttttatagtgacatggttagaataataataaagaaaaaaccataagccctctcaaataatctatcagcagggactcttcggatctttctgaagatatttttactctttgaggctttaagaaaataagttagttttcaaacatgaaatttatttagtatattttattgtgtcagtattatcttaacccaaaattttaaagactggaaaagtgcctgtgatacaacattaaacaaataaaatcagaatatgaacgtaataaacagaatgatggtctcccaagagttcagctgttctttccttttacataaccctctgtcttctatggggatctatctagattcaatggagaagcatatgatctagattaagccaattatgtgtccctcaagactttttataaacattctgtgacacaagtaacctttcttctatatggcgttgtgcatacatataaagctcagaaatgacgcaatcaacaaggcaataaagctggcacacagaagaatgaaacccagaaaatcacagagcgagaaccccaatcaagcatgattgaagcttatccttcttctagacccttaacattacatgaaataagcttgctttttatataagattgatctggaagtgaaaagagaaggaaatgtagcatttctaagagcagtcttttcagtcggcagcctgaaatccactttgaccaagagaggctgttgatttagagcttgcaaatttgaaaaagccaaattccctaacacaagttcacattagcactagcagttgcagagagatggaagatgaagtacaatgtaagactggggtccttataaatcctctttgaagtaatttctcttaaatcttctttacttgcaaaagggaacaatcactctttttgtagagattaagctgcaattcaattcaatggtgagaaaaaaataagccatctatcctatgatttaaaattgttttaagatggatttttgctctgaccatgctgaaataaagggtaacatctctaaccatcctgacataagcagctatataaaactggacaggctgcgcggtggctcatgcctgtaatcccagcactctttgggaggctgaggcgggcagatcatctgaggtcaggagtgcaagaccagcctggacaacatggtgaaaccctatctccactaaaaatacaaaaaattagccgggtgtggtggcgtgcacctgtaatcccagctagttgggaggctgaggcaggagaatcgtccaagcctgggagctggaggttgcagtgagccaagatcactgcattgaactccagcttgggtgacaaagtgagactttgatcaatgatcaatgaacctgaagaaagaggaacagaaagtgagtcaccatctcaaaaaaacaaaaaacaaaaaactggacaaagtttatgaagctatagttttaggaattttaccacaggtagtgaagaactatgattcctaagaaaacagtaacctttatgatttcttaggattttacccgggatggcctttctgaaccacagtgtaagaaagtagagcccaaatgcatcatagtggttttattaaactgaaaagttaaagatgtaagttgggggcttctggaaaagctcaatttggtgtgggcagagttacagagaggtgagaaatgcacagagaaaacgctccaaaacttatcatagcagtaacatgaattctttggatgaaccccaagattacatatacaggtaaagtttttataaagtgagcagagaaccgccagtaaatgagctgaacagcaattccagacatcccaaagtacttgaaaatgtaggaggtcagaccaggtagcatggtgagagctgggcattcaattgagactcccataaaagccatgcattatgactaggactactctagtgcaagagtgtgggtcatattaaactttatcaaagtttaaaaaataatgtgatctgctgttaaattaactgctctcaaaaacaaaacttaatactttggaaagaagacagaaaaagtctgcattctcatcaatgtattccttacaatgtccagaatacaatgtaaattattagacctgtgtaaaatgtaacccaagattatataatctaatccaagaaaaggaaataaataaaatcagatatgagaattgttaatattagcagaaataaattttaaaacagtttttaaaatatttgtaaaattttaaaggaaaaactgtttaagttgatgtgtgggtaatctaagattataactgtaaaaaaaataaggttctaaaattgaaaagtatatccgaattgaaatattcacagatgagtttagtagcaaattggacaccgcagaaaacatgatcaatgaacatgaagaaagaggaacagaaagtgatatccagacataaaaattctgatgaaagtgaacaaagcctcaatgatatggagagaaaataacaacaacaacaacaacaaaccaaaacgtctgccatatgtgcatctgaagtccaagaaatataggcaagattggattaaaaaatttagtgaaatagtggctggaaaaaattcacatttggtgataactattaagccaagccaagaaactcaaggaatactaagcaggataaagatttaaaaaaaaaaaaaccaacatcacacatagcatagtcaaaattgttaaaaagaaaatataaatacaaaatcttaaaaacattgccagataaaaaacacattgcatacaggggaacactgaaagaattaccttgacttttcctgaagtcagtgcaaggtattaagcaatgagaaggccatctttaaaatgccaaaataaaacccaaatttgtcaaccaagaaaatgtcttaaaaaataaagacaaattaatgactttttcaaatatataaaagttgtaagaacttttcgctagtaaagttacactataacaaatatcaaagaaattattgaggggtatttattgaagaaaaatgatagttaaaaatgaacacaaattcatattaagcaacgaaaaatgtcagaataactgtgtgggtaaatatttttatttttttcaaatttttaatagataattcattctctgaaatgaaaacaaagtattatactatcaaatttatagcatatgtagaagtggttgacaataatattacaaaagtgggaatataacctaaaaatatgattatttttgtgtttattctgcctgtgattcattgagtttcttggatctgtgaccttctaatttttattaaatttggcaagttttgtcaattatttctttgaatactttcttctgtcctttctatttacccttctctgtgcctccaattgtttttctattagcatgtttaacatttccccacacgtaattgatactcagctcatttttcttccattatttttatttatcccctctgtatttaattttggattatttctttgcctaggtcttcaaatttagtattgtttttcttattatgtctctgatctcccataaatcataactagggtagtttcttatcagttatattaccagctctagaatgtctactatagacccttcaaccttccattcttttcctcctcatgttaacattttgctctactttttgaatatactgtttatttataatagctgtattcattattttgtgtgttaattttgccatttatgacatttctaggactgtttgtgtgatctctcctcccggttttgtcatattttcccacttcttcacatgcctagttatttcatgacatactagacattatgaaatttacattattgggtgatggatttggggtctttctttaaataccattgagttttttggggttgtagttcattacctggagtcaggtaataagcatcgatcttaaaattgttgaaacaagccaataagactctttattctaaggctaatttgggctcacttttaatgcgattatactgtgaggagtttactcaatgtctcctgtattaggaggtctgtccactttggctagtgtgatcccaatgtattttcaggcctgtgtgaagtccagggacaattttgcctattttttattggttctttttctcgtaccatgtagttttctaatatgttggctcagttcagtgttcagcagtgactcacaggttcgcctctgccgtagtttgctcttctttctctctttacttctgtatcacttcatattctttcccataaattccatccaacctggctttctcaaatttttcattgttttcacaagtcagcaaaactcttaagatctatttgtattttgaaagctctcctgtgatgtttccttgaagatccttcctggaaataagccagggaaatgctgatgctcacattgccgtctttcaggttcattgctgtgtgctgcttgttttgccatatctgaaaacaactgggtcacatattttgtcattttctagttgcagtgaaacaggaggtaaattctgatcaatttctgaactgaatttaaaaaataaatggtaagaaaattaatgcttttttccaatattaaaagcaggacaaggatgtcttctgctttcaccagtttcatttagtattttactggcgattgtagtcagaataataagagaaaaagtaataaaaggtatatttaaaactttctattaaaaatgacatggtattctatatagagaatgctaaggattctccaaaaacaattaaaaatgataaatgaatttagtatgtttgtgtactaaaagtgtactaactgtatttctatgtactagccacaaacaatagaaaattaaatttaaatagacaataccatttataataccataaagcatataaaatatttagggataaaattgacaaaatatgtataactctctaaacataaactatgaaactttgatgaaattttaaaagacctaaaaaaggtaagatatacatgttcatagttcagaagactcaatattgttattctcatacatctctctatactaatctatacagtgtaataccaactaaaatgctagcattttgtggatattaaaagattctaaaatgtatatgaaaaacaaagtaacttaaaataattttgaataataacaaatatgaagaacttacactacctgattttcagatttggtttaaagcctcaccaatcataactgttatatttgcataaggagttgtattgatcaacagaacaatctaggaattaattttggttaatgtggttgtttctttcacaaaagtgtcaaggcagttcaatgggggaaaggataatcttttcaacaaatgttgctagaacagttggatatccgttttgaaaagaaaagaacaaaaggaaacaaacaaaaaaccttaaaccttgtcctttgctttaaaccatatgtaaatatttactaaagatagatcgtacaaccaaatgtaagaagtaaaactataaaacttattttaaagtagaaaaatggaagaacatttcactgaacttggatttgattaggacataacatcccataaaataataaataaatcaaatttgtcaaaattaaaaactttgagtataaaaagcactcttgagcacacaaaaaactagctacagggagaaaatatttgtaaacaattatgtgatattgaacttttatccaggatgtatgaacattcattacaccaacaataataagaataatagcaacaacataataataatatttataaaagggggaaacatttccagacactttaccaaagaaaatatactaaaaatagacttgtaaaaatatgctcagtaacctgtttattaagaaaatataaattaaaaccccaaagaggctttcctggggtaaagagactgaaggcttgcattacctagtgttggcaaggatgtagagcaactgccattagaaatgtaaaatttgacttcctctcttcctatttgaataccctttatttctttctcttgcctgattgccatggccagaaatgccaatattatgttaaataggagtggtgagagagggcatccttgtcttgtgctggttttcaaagggaatgcttccagcttttgcccattcagtatgatattggctatgggttcgtcataaatagttcttatttttttgagatattcaaattttctctgcttgtaaatgacatggttccatatttagaaaatgccatcatctcagcccctaagctccataagttgataagcaatttcagcagtctcaggatacaaaatcagtgtgcaaaaaacacaagcattcctatacaccaacaatagacaagctgagtgccaaatcatgaataaactcccattcacaattgctacaaagacaataaaaacctagggatacaacttacaaggaatgtcaaggacctcttcaaggagagctacaaacctctgctcaaagaaataagggaagacacaaataaatggaaagacatcccatgcttatggataggaagaatcaatattgtgaaaatggccatactgcccaaagtaatttatagattcaatgttattcccatcaagctactattgactttcttcacaaaattagaaaaaactactttaaatttgatatgggaccaaaagagagcccatatagccaagacagtcctaagcaaaaagaacaaagctggaggcatcatgctacctgactacaaggctatagtaaccaaaacagcatgatactggaaccaaaacagatatatggaccaatggaacagaatagaggcctcagaaataacaccacacagctacaaccatctgatctttgacatacctgaccaaaacaagcaatggggaaaggattccctatttagtaaatggtactggcaaaactggctagccacatgcagaaaactgaaactggatcctttccttacaccttatacaaaaattaactcaagatggattaaagactcaaacttcagacctaaaaccataacaactctcgaagaaaacctaggcaatacacaaattcaggacacacgcaagggcagacttcatgactaaaacaccaaaaacaattacaccaaaagccaaaattgacaaataggatctaattaaactaaagagcttctgcacagcaaaaaaaaaactatcttcagagtgaacgggcaaccaacagaatgggagaaagcttttgtaatctacccatctgacaaaggttaatatccataatctacaaggaacttaaactaatttacaagaaaaaggcaaacaaccccatcaaaaagtgggcaaagtatatgaacagacacttctcaaaagaagacatttatgtggccaacaaacatatgaaaaaaagctcatcatcacggatcattagagaaacgcaaatcaaacgcacaatgagataccatctccaccagtcagaatggtgattattaaaaagtcaggaaacagtagatgctggtgaggctgtggagaaataggaatgcttttacactgttggtgggcgtgtaaattagttcaaccattgtggaagacagtatggtgattccttaaggatgatgtagaaccagaaataccatttgacccagcaatcccattactgggtatacaaccaaaggattataatcattcttctaaaaggacatatgtacctgtatgtttattgcagcattatttataatagcaaagacttggaaccaagccaaatgctcatgagtgatagactgtatagagaaaatgtggcacatatgcacaatggaataccatgcagccataaaaaagaatgagatcatgtcctttgtgaggacatctatgaagctggaagccatcattctcagcaaacacaggaacagacaaccaaatgccacatgttctcactcataaatgggagttgaacaatgagaacatatggacacatggaggggacagtacacactggggcctgttgggaggtggagggcaaggggaaggacagcattaggagaaatacctaatgcatgctgggcttaaaacctagatgatggattgatgggtacagcaaaccaccatggcgcatgtatacctatgtaacaaacctgcacattctgcacatgtatcctagaacttaaaataaaataaataaataaataaagaaatgtaaaatcatctgcctctttggaaaataggttgtcattttttgtgtgtgattttaaacatatatttaccatatgatctatcacttatactcctaggtctttactcaagagaaacaaaaataaatccacacagtgtggtacttaaaaattaaaattaaataagaatactatatataataacatcaataatctaacagctttatttagaataatacagatttgaaacaattcaaatgcctattaactgatgagtgggtaaacaaattatgatatatccatacactaggacacaactcagcaataaaaaggaacaatttgttgataaatgcaacaacataaatgaatctaaaaagtattatgttaaataataaaaggcaggcacaatatattatacactatatgatgtaaattttgtgaagttctggaaatgatgaaataataatgatagaaaacagatcaattcttgtttaagaccactttggaggaggcttagctgcaaaggggcaggaaagaatatttgtaggtgatgaaaatgttgtatattagcactatcgaaaataactttctgtgatgatggtattgttttacaaattttcactgtccaaatgcagtagccactagccatctgtagttattgaacatttaaaatgtggctcatgtggtcgattaaatctattttacattttaattttaattaatacatttaaatagaaaatactgattaatttgggtgatatgcatcacttcttttgacatcatttgtcaaaatacgttacattgtacagttaaaattgattaattttatcctatgctaaatatgcctcaacaaagccaatatgaaaacatattgaatacttgccaatcctagttttctagttagtggttgcttacaatctaaaagtaaattatcctccaaccactccgtcttcaagttcagtgattttcagctactgagaaatctaatcactagagaggaagcaaatacttgttatactctttagaatacatggttttataatcaccaagaatttggtcttttgctatcgtgtttttggaactcagttgtcacatattatccagcatcatctattttaccaaaaaaatctgattatttcttactatttgtttctgccattacagagtgtatttaataagttgatccctgtgaccatttgactgctttcatttcaggtatatttctatctccacatgggcaaacttatcatacagtatagatattatttggtaataaacaaccataaatggcttacaataatataaatttatttcttgtttacaataaataccattttacttcaactgggagcactctttcatgtctcctgatatggagaccgtggttaatggagattccaccatttggaacattgccaactgttgtggcagtaaaaaaaataatgcatggtgaaccacatacttcttgttaataccgccgtaaatgtgaagagcactatatttaccaaagcaatcaaatactctaagcaaccccatccctaaatctatcaggagataagagaaatgattagaatgctgaaggctaaaggttccattcttccctcaattcaccatactttcctaaattaatgtaaatagaggggacgtttgcttaatgcttcgtcaatacacctaccacttcaaaactcaatatttgatgtccaggcatgatggctcatgcctgtaatcccagcactttgggagaccgaggtgggcggaccacttgaggtcaagaattcaagaccagcctgaccaacatggtgaaatgctgtctatactaaaaatacaaaaattagccaggtgtggtagcgcacgcctatagtcccagctactcaggaggctgaggcaggagactcgcttgaaatcaggagggagaggttgcagtgagccaagatcgcgtgactgcactccagcctgggtgacaaagtgagattccctctcaaaacaaaacaaaacaaaaccaaaaaaaccctcaatatttgatgatgtaataaagtacctgagcaaatctggtatttaagtgctactttatattgctgctgaatgtattcaggcaagtttatgtaaagacaaattatgtatcatatcatgttatatcaaattgtcatattgttatttttctagatttaaaatttgaagaaaaaacttctattattattattctttgtatatcaaggtactgttgctgaaataaatatctttctactgtttggagttgaaaatacctatcctgctataataagctaataaaggaagtggtttatttttgtaaaatcctttattgataaaatcaaaacttggcaactctgagtgcacaatctttaacttcgaaattctatgaaaaaatttctttttggaatttgaatcatttaaacccacacattttgtaaaaccacagccattttttctataatatggtcacctagtacatcacctcttgctggatcagtcttagtctaatgccacaggacttatacctagtaacctataacttgtgtatctataagatgaatatccttatatattaacttattatattttacaagtccttatgagacctcatggacagactgtgatgtaccttggaaaatataaggtatgagagactccagttcttaaaacttttgggtcataaaattcatacttcatagaagtattacaaatttaaattactaattgctttatttttgtttttaatgtgcagtgtaacaatttactcctagctatattacgttttttaaaacttaaaaaaatatgaacatgagtgattataacatttatcatccaatataaatacttttgtgagttaatggggtactatttgaaattatgtcacagagttgtataaatagatatggtgctgggtaaactagaccctccctatggtcatgtttgttataaatatcattatagaattgcattaatacgtatattctaagaatatgtacatatatacctattataagatgactatgttatacacatacataaatatgcacagtgtgcagactacatgtatacatatacagacatagtggattccctgtgtgtgcgtgtgtgtgcatgtgtgtgtgtttgagtcgatatatattcatcttagaaatgtgggctttttgtttctgtcatggtgaaatagtgtgactagtggaatctattgtgaatatttaagtgagatgatttttctgataattcttcttttcacacaatccttcaacaaggcactcttaatctctttctaaatattatagcagactccatggactgggctggagtggccagggatttggtaacagctgaatgtttttcttcatagagttattacttttctgatatcatcatttgattggggcttgagtgctaggaataatttggctttctattccgcatgtgttaaaaatagaagaaaaacactttgtactgacttaagtctccttcccacctaccctccacctgtatcccccaaaagagtcagacagagagagagagagctagagagagagagagaaggggtcctgggaatcttgcagaattcaaagacaagcaaaccaacaggaatcctggaggctttgctgcttctaccctttgtctctatttctcactgcacgttagcttatttcttcaaattttctttctctatttattttttgtgtgcatacaaccatcccaatttgtcaagtttctctcccatttatgagtccagccaagagccaagactgccatatttttttcctcaattgcaattccaaatttctaagaaagaatagctttggctcaatttggttccagtttgctcccccgactcaaaaaacagtaagcacaatcacatacaaagacacaactctcagaaaagggggtcattgtgagcttggtgggcaccaccaaaggaattttcaatggcacctcaaactaagaaaaacaaagctagattctcataacttaaatacaagctttcaaagtacagggttggcgcggtggctcactcctttattcctatcactttgggaggccaaagtgggcagatcagttgaggccaggagtttgagaccagcctggccaacatggtgaaaccacatctctactaaaaatacaaaaattagttgagcatggtggtgtgcgtccataatcctagctacttgggaggctgaggcaggagaatcgcttgaacccacgaggcagaggttgcagtgagccaatattctgccactgtactccagtctgcacaacagagcaagactctgtttaaaaaaaaaaaaaaaagtagagcaaggcaatggctataccgtaaatgacattcttttgctctcttatttaatgttcaatatgtgctgctataattttttctaccataaaaattttaaaaatccaaacaataaaatataatcacacatattggattcaacaacaaaaggatcaccaaaatcaaatatctcactgaagtatactttgggactaagaatagcaatcactgtgcataaaaatgaaattcaagaccttgaaaattgcattgctacagcaaaaaaagaatagaccaaagtaaatccactagacagaagaatgtgaaagaataaaaggacctgagaaatgtgtcactcccaacatcagtcaactacattttttaaagtttaaatgctgatgcccaactgacagagattctatgattacatttgatacaaatgccatttatatttcccggttactaaaaaaaaaaaatattctttagggaatgtggctgaataaatgtttaatggatggcaggttctcaaataaattaacacagatttcttatttcaaaatggaacactaataataacctaggtaatgtgaatgtttttatatttatgtggatccacttggtaagtgacccctgggatccaagcccttatgcctaagaaatatcagttagacaccattgtgagcacatagattgtctactgagcacttatattgcattgtcccatgaataaagcagagttagaaatttgatcagtaagcctataaattttgtattcataggtacaaatagaaaaaaaaagcctatgagttgctacagggacctttgtatcagtgaagtactgaatttctcctagtctatgaggcactaatatattttagaatttgctatagaaaactccgtttaggatgaaacaagaaagtacgttaactaacaaacaaatgaacaaacaaagacattaaaaataaaggttaaagggtaaaagggaaaaggtagggtctcagaaattacctataaaaagtgggggtcataggccaaccagctcctccatgttactgggtacattgtcacagtattcagtataatttagtttacctaatatcattaattttacaaaatcatctgatattcatcatcatataaagctccatgacttactgtttaagacaaaagagatgacacattttttttggtagaagacatggcatatatacagtatttagaaaacttaaaccaataagatcagttctaggaacattgaagttattcatcatgatgatgggagttagggtggagagaaattacgaggaccagattccatccatgtctttaataaatatgaagaactaataaagaagttaacagatgatggcattgagaacgataatcaatactgatttcataagccccccaaaaggagggtaaattgattagaatttgatgcagggtgagaatcagaaagcctaaattataagattttgattattgttatcataaaaatcaacaatattgagtttatttcattgtcaattaaaaattttgaggtaagcattttagggaaagtggggcaacccattctgtcaggcttcatagattttattgctcttccttatgtagccaccactttcacttcatggcccaagatactggtctagcttcactttctacctattaggaaagagaagagagaaggcacacacaataatcctcccactaagataactttgtataaattgtgcacatatttctttttacattctataagccagaattgattcacattgaaattgagcctctattccagatagtcgtgtgtcaaactaaaacatccaagtatctttttctggtgaagaaaaccaaatacggagagataattggcatgtctataacagataggagttcttgcaagatgaggaaaataatagcttaaaaagacaaaggaaactatgagtatgtggaacaactttttctggctccttgtaatgcagaatgaatataactttatcatttgcaattatcctttccttcatctcttttggattttactttgcttattttgtcttaaagtttgtttgcatctataatttgctgtcttcattaatggattgcttgcttctatttctgtacctatccatctctttcattgaaaatgagcttgtaggcagatagcacaacgttagaggtagttagttttcaggaaaacagtattagagtagcagttaaggagcatgtcttgaaaagaaacagttctatgttcaaattttggttctgccacttgccagctatgttacttggacatgttactcaacctctgtaaagcttagtttccttatctgtgataatgcatgtaaagtttctaatatggtacctggaagatactatctgaaataaatattagctatttttggtattcaaaccaaatcacacatagtaagtgccttttaaatatttatttggttggatagaaagcttcactgtcgttttcagatctaacagagtctgtaaaggaagaactctgctcccatttaattagaaatggtattaaaaaattaacttcacagctcaggaactcagacactatcaagtgatttcacatcatcttcaccgctaagccgctgacctccaagcacttgattattactagattctcttttccagttaggttatttcacactgggatgaagcagaaggcaggagtgtaatgcataatttcaaggaatttaagatgagaaaagggaacaccatgttcacattatggaccagtgatcagacagttatttacatgcttgtcccaatgcacatggccatcttctaatctagtagatcttccaccccctgctatataggaaacataatcagtgtgcatgcaattcacagggataactacattaatcagcagttgagttgaggtggaacatggcagagttttagtttatttttttctacttcctttagaagtgtctgaattttacacagcaatcctgagcaaatgaaaatggcacaagtttccactcatggcaggatgcatggatcagatcacaaatagtttgatctataactcagtttccttttcttgttcacagtttctgcaccaaggactttttggtgctgactacttggctgtttgattgagacaggaaaccagacacatcttagaggatttacaggagaatctggaggtgtgaaatgcaaaaacaggagtaaacactctaaggaggtaaacagcaacagagaacttcccaaatgagaagctatagatcagacaagaaaactgagataaggatgctaggtcctataaatgttaagtgtaaacaaattataatctcagcttcagggtgactggtatgccacaaaaggacttggagtgcttgctcaaaaagcataggttgaattaattaattcaattcatggaatctacattatgtactattttaaaccatctctctctctcttttttaaataaactattatgtgtttttagttttaaatacaatgttattgataatttattattagactgagaaaattgtaatccacatagtctcaatcgttgtttctcattcattcctcatttgtgaaatggggcaatattagttataccttaaagttgttgaaaagattaaatggaatgatttatgtaacacatattctaagttaactggcaccctacaagtctacagaaaatgtttcattactagtttatcaaggatttatccatgaaattattgcatgtatataataattgtatgggtaaaccttagatgaattaagttaaaatagaaggaaagatgtttttcagatgtaaaagaaatggcttctctaaagtcaacatattaagaaaaaagagtcatgtagtttctaatgatcatctggtaaccagaaagcatacactccaaatatttctaatcagactaccatattagggtgattatgtagcctgaaaatatgccatgtaaattaaaacacttaccttccaaatagccaccctcgtgggatcacatgatacgttgaacagtacatgatttcagttttagcaactttagacttttaaaacaagatttaaaaatgatatctaatattactgtaatcagagtttcaaacagaagtagagtataacatgaaaaaagagaccctatttgtgagagagactcctaaaattctctacagcctaggaaacccaaattaactttttgtctgtttttgacataacagtgactatccatttaacagagtagagtgcacggtctgaaatataattcttcaagtagcctcttttataaagaaaaagaaaatacagcaccatctggtaaaaataaaataaagtttgtagtgaagcaggggaaccaggacggtatcaggcacggtattgtctccttttctccttaataaagtcattttatggatcttatgtattttgcattgtagagaaagcactttttcttagaacacacaaaacgcatataaacacagataaggaggctctagcaagatgctttgaactctttggaaagcacctatagaatgcattcttgtcaatattttatatggtaaaactttgaaatatcacaagagtttcaaaatgttcccaacaaaattgaaagtcatacattgttacatcatgaaaaagtgggacctgaaccagataataattttctaggtcatgcaaatattcatggttttacttccttctcattaaaatacccataccaaacctatgataaggcataggtttcagactcagacagacctgaattcaaatttgaccctttcggctccaagtcttgggtaaattattcattctcagagagttgtggtttctcttttgatcctcatttgttaaaacaggcaattttaattatatctcatggtggttgagatggttaaatgagatgatttatataatgtccattggacagcacatagtatatagtaattgcacaacaaatatgtggttatcagttcatttaggatttatccatgcaattattaaaccagtgcattgggagtaaaattcttcacagacacatgaactctctaaaaatctaatagaagtggataaattaaaaacacagggtgtttataacttgctatatgcataaagtaaatatgaaatattctaatactcaattattccatttttactttttatttatatatataaactcacaaatttgtttttacatgtaaatataaattttatatattatatgtaaatataccttaaatataatactttacatattatatagatatataaataaatataaatgcactttaaaatatactcagtggtaatttaaacttggatgctactggctatttcagtaatcagaagtttagattttcacatttcaaccatcagcttttactgctttattctctgataatgtattttacaattttgtttcaggaaaatagtattagttttaccactactaacttgtggtcccatctttggcagctactacctcaaaaccatctttataataatcagaaattagaattccaaataagtcatttaaattcatttgtcaaactgctccttttccaggctttccaaaagatgctaataaatggtaattatcttcaggtattagcaaaaaaatctaattttaaaatttgggaacctatttattaccattctcagtattaaatatctttcccagttaaaaggatgaaatctgtagattccctcctccccattttgcaatccatcaactttacagaaaactattgattgttttccagtgaatataaaaacataactaatatgtagtgaattattatgagctcgccactgactaaagcactttaaatgtattaatattatctcatttaacttcaaattaatgactcttttcccctacttttagataatgatactcagagaagtagagaagctggcctaacatcacaaacctatgctgttgtggagctggcatttgaaaccaggtgttttcattacattctctgattttaaatactttcaaaaaagcaggaaatctacatggacttcaaagaaaattgcctaagaatatcttctttgaatgcatgcttttaacattaatgttttttcaggattattatatcaactggatttctcacactcagtttcagtttcttcaccactcaaatatgcatagtttctcctccttgggtagaagccacagtgttcctcagttacaaggagtgctttatatgagaaatggcataaacaactgttgatacttgttatggagaaaagtcaaataactcagaagcatgtgaaatctgaagtttaatattttgaaagagttgctatgtagaaaacaggtggcagaactagaacccatggaggaaaattaagggatgaagattttggttcaacaccagaaaaaaatatttttaaaaagaaatgtaattagtgttgtctaaatcataattgaacagtctcaggaagcaatgagctctctgtggataaactcatattctggaatgtaataaggcaaagatgtaatagaaaatgatccagcaatagatggggatagaaaaaatataagcatatagttatatagtttgtgtcagtttcctcatgattgtcaagggttggtggagggttagagaagaggaggtcgcaggatgctatggattgaatatctgcatacccttacccccaaatcaagttagtatgttgaagtttaatcattaaaatgatggtatttataggtggagcctttgggaggtaattaggacatgagggtggaaccctaggaatgagattcatgcccttataaaaagagatatgagagggcttgtgtcctgtccgctttcctccatgtgtgttagattgagcagctaaaacagatacaccatacattgggtagcttatgtgaccacacagttctggaggctgggaagtccaagatgaaggtgtcagtagatctagtgtctggtgaaggctggcttcctggtttgcagatggctgcttttcccttatattcccacatggaggaaagccaaaagaagcaagccctctcatatctctttttataagggcactaatctcagatgagacagagcaacatagaatgaaaaaataaaaagaacaaaatagggagcatgaaattttagtgacttgacaaacaatagacatttttctttctctgctcatacatcgacagaaactgggaatatttttgtcatattctgccacacttgaacaaatttcagtggaggcatcataactgagcctgtgttaagaccaaacctttacttgacttacaaaactttctgtgagtttttttcttagtatggttgatttcttcaagaaaaaggatgtaagtttaccaataaggtatttaaagtacaagttacttaattctttattagcaaatagttggctgctaatttttgcttctgaaaacacttaataattaaaggctacaatatttatatctcaagaaacgtctcaggttttttctcgtcactaagcttaaatcttactcttaagcaaaaatattttaaatttgaaaacatacattgtatttgactattagctttttttttaaagagaagtcattaaacttaaagctaaaaataaattttatatttatgtgtagcagttaccatattgatgtgctaaaaagtttatagatttagctaccgcaataacaactttctaatcaaaagttgagactgttgtgaacaactcttttgtgaatataacctagcattgtacagtatagattgactatcgcatatgcaaaatgcttggaaccaaaagtgtttcagatttcagattttttttttttcagatttgggaatatttatttgcatatgcataatgagacatcttaaggatgggacacaagtctaaacacaaaattcatttatgtttaatatacactgtatacacaaaactgaagataattttatataatattttacgtaactttgtacctgaaacaaagttctgtctgtgttttgactgagatttgtcatatgaaatcaagtgtggaattttccacttgtggcatcatgtcagcaatcaaaaagtttagattttggagcatttccagttttgaacttttggattagagatgctcaacctgtatttcctacaaactgtcattaggaaaaatcagaagactaattattgtctaaattttaccgtctagaatttctaatatcattcagcattttcaacttttttcttaatagtttcatattggactgcttgcttcaaattcacacattaacctaataattaaaagctagtggaaagaattatcagattaaagccttaatttctacaaagcataagttaatagagaaaaacaagtgcaaagagaggcaccaggtggttcataggaccttcaggtaaaacaaatgagattttattaggcttacagatagaatttttgcctgtgtgtcaagggataacaggagtgttgatttgagtggcttatgaaacaggcatgtttagctcagcaatattactcatcacttggctttttaatctgccaagagatgggtacgatttgcacttatgaactgtgtgtaattatggtgattcaggttttggcttataatgaatcctccatcacagtctgttttctcggtcttttattttctgttcctctaagggaagagagaccaaagagaattctactttgaccctggcttaagagtggaacatagatgtctataaaactatgtggtatgtacatttataaaaattttaatttgcattttctctaggttttatgtttttggtgataacagaataaagtgtgcatgccatccaagataaatggatgaaggaagttcacttctttttaattatcttatactgacagataaagcaaaatagaaaaaaaattctgtatttaaccttaacaagctgagacacactagagaagtggaaaatagattgtgtgcatctgatcgtgctgcacattccctttaggttgcaatctctgctgttattaccgacaacaactgagactacagttttaactctgtatttacttctagttatcccacaattggtacatagtattggatggagccctgtatttcaaggagttcaactacctaattttcatagctgagataactaagtttctgagtccgttttcctttttccagtctgatctctccttttctcaaggctactttcgtttctgataacatactaaaggttataggatttatcggtattttgcctcctggggtcatttgttattaaaaaagaaactctattcaaataactgaatctctactattggattttccaaagctatgatagaccagctagtgaaactattttgtactggaatttggcagggtgatggggtggggagaaggtgtggagaggaattcttgtcctcagtcctgatatttctttccaggtgaatgtggtcttccgtgtgctacactccttgcctctctctgctcttctattcactatctaccagagaagatggagtgattcactctgattaataaatttggaaaaaatcaattagacatgctccgaatagttccaccctttttgtcttagaagacagctgccctcagagagcaagattttacctttgtaaattggtacacatgatctagcttagcattgcttttaacagggggaagtctgtataattcctggattattatcatgccagtgggttctcatattatactttatcctccaaattaattttttgtggtgaaattgatgcttttacttcttttcttttcttttctttttttttttttttttttgagacggagtctcactctgtagcccaggctggagtgcagtggtgccatcttggctcactgcaagctccgcctcccgggttagcgccattctcctgcctcagcctcccgagtagctgggactacaggcacccgccaccacgcccggctaatttttgtatttttagtagagacggggcttcactgtgttagccaggatgatcttgatctcctgaccttgtgatccacccgcctcggcctcccaaagtgctgggattacaggcgtgagccaccgcgcccagccgatgcttttatttctatcttctcatttgtgtaaagtgaataatgatatctcactgtgatttctagttcatttttgtgactcacaaatatagatactacttccgttatattacctgtttattttcttatgtgaattgctttctcatacccttttctaaattttctcttcagtactttacaaagggatttgaaagtgagtttggtgataatacgaaagtatttcaagtggacaaagtgcaaataatagtatcagttgatgttagcatacacacacaggaatgtcttcttttatagtaaaatttatttatttatttatttatttatttatttatttatttatttatgacagagtcttgctctgtcgcccatgctggagtgcagtggccctatctcggctcactacaagctcagcctcccaggttcacgccattctcctgcctcagcttcccgagtagctgggactacaggcgcccgccaccacacctggctaattttttgtattgttgttagtagagacggggtctcaccgtgttagccaggatggtctggatctcctgacctcgtgatccgcccgcctcggcctcccaaagtgctgggtatagtaaaatattgagtgtgtgtgtatatgatagagagaaaataatactaattttaagagagttatatgaaaattcttttagatttctaaggaaaagactgactcgaacaaatggacattttaagaaagctattgctacttagtaatgtatgagtcaaatggatagaaactccactatttgatgtgaggtgtctagaatgttgggaaagtgttaattcaatagtgctgtagacaaaaagttttccacattgatcctatttgttcacccatctccctccacctaggggaactactttttaaaagatgttatgttgttcaaatttcatatataaccaatgtaagtgagccattagtgtttttggagtatgaggtaatagattcctgtcccccaccaactcccttatttatcccctttatgatttcctcacatagctaataatgcaacaagaagagctttaggggtgcagagaactcagaaatatcccattgcaatagaaggatatgtttccttttaaggtagctccgaaacagcccattatataatcattttgtcccaaagcagtggctttcatactcaccctgcccatgggcctgaccataactgttatttcactaaatcaggttatttttggagtgcccaattctaagttggctgctactggtgacatacatttcattatagtttgagagttgtcaatataaatactccactcatagacaccaagaaggttcttaggaggcaagatctaatctttagaaaaattttattgacatttcataaaatatttatttaaagcttgagaaggaaactttctggctgttaatgtttttcagctaccaatgagtctaactcacgcatcttttttcttttggttgcaattattatacaacctcctgcacgcccgctccattgcacctgcctctcaaaacctaaagaaaaaagatttaagcagctaaaattttaataaaatatggaacagtcacatgaatttctgaactttaaaatggggaaaacaatcataggctctgatggctaatttcagaatcctttacatttcataatgaaaatttctatgtataaagattcaaactatttggagacttacatttcaaaggataattctactttttaggcactgtaacttatttttatccaagagaaagaagaaatggttaactgaaaagatttagtgacagtgttgtgataggagtcaaaacgtctctagttggcataagcataggaaaataactttgttgcaaaacacttgagctctgtttgcagaaatgaatggctagcggatatttttgttctctctgttatactaatggataaaggcatgctgataagtcactgtagctctgtggggttaatgccagaatgaaataccagagctgtactctttcttaggaaatagcagattcttacagacatgatcacaacacattttacagacaaactacattgcctcatgtactgtagcccctattctgtgctttgggggtcaccacaataatttctcttagaaatttcctaatttcaataaagcctaccatggaaacttatttggttgtttgttccctctcttatatctgctcctctgcgtctttcccttcttttctggcatttgtttttcttctgttcctttggagaaagcacagcctttagagctagtcagtttagaatttagctcaaattttatcttggtcacatataactatggaaaaagtatttcctttctaaaacctctctgttttttcatacggcaaatggagactatatactctacacttaggattagaattaactgagagacacacacattttctcattttcttttcttttttttttttcttttctttttttttttttgcttctcaatcagctcagttctctgtagtagatgaggtagttatcaacggggaggagctaggagtttccagcttagcaatttaatacttttaataactatacaattatttcgtacaaatacaagaacctaaacagcttatagagcaagaattacagtaagattggcccaccatgcttttcgcaatctcccatagttgtgctttcataaacaaaagtgctaacctgaacttccaaatcaacaactaagctctggctctattactacatcccagaaccatgacacagatacatgattatagaccctgaacaacaatgcccatcttcacaggcactttgaaatggggcaggtttcattttagagtatattttaaggcataagagtttgcctccagaattttaagttgtagtgaaaatactctgtctgtaacatagaaaaataagcttagaagactctccgagtttccttcatggattaaaaagttgaggattcttttaactacataaattctgtgtcctttcaaatagtagtacccttacaacttaaatagcacaggtgtacgttaccatttcataccgatcagccccagtggggcgtggaggtaggggaaacagttaaatagagactttcccagatgtgttccaaaatctgtcatttctgttaaattggtaattatcaaatttatgactaaataaagatcatatagagcttttctaaacacagatttcagagtctcaaatttagagagtctacttcagtagctctggagcataggctaagactctggatttttacaatgcattttaaggaatcttgatgtaagtagtccttgaactttactgaaaaactttgccctacaccctgccttataaataagttatacaactgcttcttggggctgttaagcaatggagtctagtgagattgttgcaatttcttgtgctgagagaaagaaatccaattaagaaatgtaaattcttcttcatgctgagagaatatgaggcaataaaaatatgaatttctttatgttgcatagaagcttctgggagcccataaagggtgagcaatccttaccaagcagctggactgtcatcatcttctctggcttttatgggagaagatgaggtacttttggcacttttctgaaaacaatctctttaagagtttctgtacaggctgcaaggctttttcttttaatgcttgaaattcataattaacaatttagaatgggggagaaatgttaaaatatggaataagtgcaatcctttttcaggatgattatctgatttctaattgcacccagcaatacagttgttcagaaagactggtggttgggaataaagaaagcgttttcagtaacttttaaggagacttgttagtgctttaaaaaagagtgaacaggctgggcgtggtggctcacctctgtaaccccagcactttgggaggctgaggtggacggatcacaaggtcaagtgatcaagaccatcctggccaacatggtgaaactccatctctactaaaaaaaaaaaaaaaaaaaaaaaaaaaaaattagccatgcgtggtggtgggtgcctatagtcccagctactctggaggctaaggcaagataatcgtttgaacccaggaggcggaggttgcagtgagctgagatcacaccactgcactccagcctggcgacagagcgagacaccatctcaaaaaaaaaaaaaaaaaaaaaaaaagagtgaacaattgaacaattctaattactactcatgctccaacatggctgtgttaccctgaagcagaccatagtacagggctggagcacatgggctactgttgaaaatgtcagaaaactaaaacaaagatgaaaagcaagtgggagtttggtgtgagagattctattgccttgatatgcccatagaagcagagttgagtgaagggagctgtttttgtcattgagaggttcctttcatttagttttctgagagaattctatgtgagcctggttgaatcctatctgccacttcaaatactgtcttcctttccatttttctgttacatatagtgaacttgttccaataaccttttcaagtagattcctggttatgtttccttccttatgccctggcttttgtaaattcaatctctgccttagtgattctaaatccacatcagacatatcctatataagcaaacatatgttgttcaagacatattcctaagcagcatcttctatcccacttctctctgtttttcattatgctcctgattcttgatttaaatgatgctattttgggaaaacaaatgtgctctgggattaacagcaattccctttgtaaaccaagcctgttaaaaatgcatttctagaagtccagcataatttgaaccagcaaatctaagcatcttctttctatgtggagagaattttaggctactatattcaaaaattgctttattagccacagaagaaatagccaaaagtagagattcccagaacaattgtaaatgagtcattgaatttagaacaccattttgaaatgattttcaatcactgaatagacttagtaagtacaaagacaactcaattctggtgtgtatcttcaccatttaaagatattcacaggtttaaaatttaatgttttctttgcatttagagtgaatttattgttggcagaaaatgcatgagagtccggactggagaattaagtcttctgttccctacataatggatctagcagaaatgtttagctatttaggattcatgagtgctgttctgccagtctacattaggcatgattagagagggccaactgaagctgggatgtattgaactctgtaaagtatgtgaaaccaccttgtgtcagggcctgtttaaggaatgaaagctaagaatttggctaagtgcacaacaatgtaaggattgaatatctcagcaatttacctcaatcataatagctcatgtcttttatcccttaggttggggcccattgtctagcttactgacttcaacttcctcttctatataggctctaggcctcagacatagtgttgatttctataagcaaccataggcatgttctgactgctgtattgtctcctaaagaaggcatcttacactgtaaagttaggaaaatcccaccatacctgaggtccaaagtaggggtattactagcataaggtcatatcactagttagtggaagagcagagatttaaattcagattttagaaaaaagaagtaaggtaaagttttgacaaatattggaatatgtgacatgtaatagatcaacttggtttgtgaattcatattaggtattgcattctgtattagtttctgccacaaaggaaggaagggaacatttatggaacatacagattttgagtcaggcaagcctgggttcaaattctgtcccactacttaatagcacagtgatttgggggaaattacgaaacctctcaaggactcactgccatcattgataaaatgggaataatactaaacttcataacaatttgcaagaccatttataaagaggttggcagagtgcctaagtaatagtagacttagtgaggactcagctgtaaagcctacactctccctaccataccatagatccttcctattggcaacatcactgtatttgtaactatgtatttccctgtcactctaataatagtcacaagataatttccattatgagatatcaaaatttccaagaccgtgtgataagtttgactaatacaattagaaataaagaaggaaatgccattatatatttgtaaagtaagattttaaatgagatcattgaaatcctacttgtttatctttcagagacactcagtgattcttttttcttcccaagtaatggattatatggattattatatatttaattgctattttgagaaaggtattcctccaaatgggcattagggaaacaggacagattttaattaaaccatttagcacatactgaataacctcatcaggaggcatgataaaagtatgcttaattggctcagaaagatggtagtaatgtgagaacttcaaacacaaagttaactgcagagataattctacatctatctcctaatcaacagcaagggaaactactaaacatttaaataggcaaggcaagaaaatcagagaataggctatactttcatctaatttgtctctcaaaaaagtttcttcaggtgtgcacgtgtattctattttggtgacaagactacataaggaagggactgctttatttctaaggctgtctgacagcacgtttccctcaatactttgtacagtgtgtatggtagtgtttctcattctattattcctttcattcttctctctatcccacctaaaacttaacacttttctaaatatcagtgccagcataggcacttaagaacaggacggagaatagaattgtctatcccatgtttctatttgtctccaccaggcaatataacgggtcagaagaccaggcagactggtcagagaatggggcagcactggaccaattgcaggacagttaaacagctagctagctagattgtaaaacagctatctgaagtcaactaagttctgaggtctgaaaaccagaagaccacaaaagatcaagtaaatgaatgatagaattgaaagaggtaggtataaatcagctcagttccatttcgcctgaatatagagaatggccattgtatgccaggacttgtgatagattatgaaaatttagaatacaaaagtaaaataatttcacacttgtttttctaagcagtattactatcagaggaaacatgtacatgagcagattataacaaaacagaatggtaagtcacttgacagagctttgtatgaggtgttagggaggcacatagcatggccacctattccacattccttgatttcactgttcatgattattgttatgtttgggatactaagaatcctgatgacatcattcttttatcttacttgagcttttctagcaagaatgttttcaatgtgagtctttttatagcaaaacttctgacatcagaatatcatttctacttctgtttttcatatattttagctttgattttatagcttccctctttttatatttttcttctgccttctggaatttttaatgtcatcttctaattcacatatttattcttaagtgtatcatcttctttgatcagttattatgtttatcatttccaccagtttacttttcagatttcttgttcttatgttactaatatatttccttatcttctaaagtattacagttattttacattattgatccatccattccagtgttcagacagtttattgagtttgtctttctttaacagtccttgcaatctttatacatctagttatcttccctaggtgctcatttcaccatgatggtatacttactgtgtctggtaatatgtactatggaatgcccaaggccatgccttcctctctgtatgtccaagttaatttagaaaaagaaaacgggcttaatttcaggaaagagagctcaggactattatttctctttgcagtcctccaccaggcaactgctgtgattgggatttatcatcaataccttaggaagaagcagcattgagaaaaggttattcgtctagtttgtcatctacaaacttggagtttaaagaaaggggatggagaagagagtgattaagtggggagatataaggcactatggataatataacaatccaagttaaaagggaaatttagactgacaaaatatctttggtttgctctcttaaccaacatgataaacaatgtgataacaattcaggctcaatgacgctaccagttatggcttttgtacttagggctaatttttcgttctttggactttagtgtacccataaataaaacgggaatatgatagtacccaactcttagggttttgtgatgattaaatgatacactattatatataaattttagagttccaaaaatgagtgtgttttactctggaaacttaaaaggtgctttatttaattttaagaaatacatggctgttgtgtaggcttactaaatggtttaggtatttatttatcccatgagtttgtgggattgtgcatctggggtacaataatttttaagtgtttagttctttgaacaattgtgcagcatacatacagacctctctgcctccctctctcccgaatgcaatccactgtgggaagcatgatttgtagctaatagtgaacatcaacttggtgaaaaaataaatttttcttacaatgaatttctctctttaatagggatttaattttgttaaaagtaataacaactaaataaagaatgttttcttcatccagtaagatcactgactttctcaaataactggtgatgctctagtatgtccataatggcagatatccagatcccagtgtgacctgctttaaactttgagaaaacagatatgcgcattaaaggataatggttttatgaggaaatataaataatctcaactaaccagactccattgattttcatagttccattgtaataaatgaaaacaaatcttgtgctaattttaaagatcatagatgctaagaggggccagtttagagaataaagtgatacagtaaaatgaaaaaaaaaggagaaatttctttttcattttgtgtgaaagaccagtatttaaagattgcaggatcaatagcacatttctgcttgaatgagagacagtgagatcaggaaaacatgacgtataaacaaaagaaaatggacataattgttcttgtattatattaataaatatagtggtaaaatggaaactagaacggatatgtaaaatgactaaaggaactgcagtgataaagtaaattattaatagaaaataccgtatgttcaactcattagtagtatttagatctctgacccacttagaaagaaatagtttttctgtcttagtgttcataactgctgaacaggccaggattggcaactataactaggactagatttcctacagtaaatcatttaagttgcatgtagtacctattatcaaaaagcaaatgaagaattcatttaatagtgtatgctggttaggaaccttcattgaaacctgattttcctccacgaagtgtatatgccttcaccatctgtagttctcaaattcaagccatgctaatgctaacaaagtggctggcttggcagatcaatcagagagggagcctggagatttacctactttggaaaggtaatttaaaactaaatccacctttagaagtgagtgtcccatttgtgtttataggtttcactagaggggagccctacatattagaagcatttccttttgtttgccaatagcagtgaagactaaggctaaaacccaaaaggatatgacttacacaagaatgagcatatggctgtcaaagttttaatcactaggaaaggaaaatatagttgcagcttgtagataaacagctctgttttagcaaaagccagatgaggacagacttggttgtaagataattggtaaaaaatgtcagccctttaaaggagcatatcagttttgcatgctcaataaaacaacaacaacaactcacctaaggagaggtgagtctaacaggaaaaattcaagcagcagaaaaatttggtacaataatctcctatgaactaaattacctgaagtattttatcagtatctttcatagagttaagaggcaggagttcaggcactgcatttaaaaatggtttggcacagtcattgccaatgttactaaaacttctaaagggataaggaaacaatttcttgtgcaattttggaggatcatatgattcatactatattggaattttcatggtaaaattgtcaatcccttggtgatttttccaactttcaacataaaattgcaagtctgttttgaaataggagcaaagtgcaatctgtctttacaagagctaaaatgtttgcaaatttcataatgttatcttatttcctgactgtacgtgttcctttagaatctttgaccaaaatccattatttacttgtaaaaagttaaaggctcaatgataaaatatacagtactcctaaatgtgctggtcaaatagactcaagaaaacttgatatgcttttatttaacaacaacaacaacaacaacaacaacaaaacctacttaaacaaatgtggaccatttttcagcaaatattttttaaaagcctacttttgactaggcaggcgttgttctttgtgtgaagctgtaaacttgaactttgttatatatttactatcatgatgtttctcatgtcttagcttcatatcctgtcttccctccctccatcactccctcccttccttctttccttccctccctccttccctccttcccttcctccattcctcccttcctccgttcccccctctcctcccctcccctcccctccccttccctttccttcccttccatttctttcatgcgcttccatgtgaagagaccaccaaacaggctttgtgtgagcaacaggctgtttatttcacctgggtgcaggtgggctgagtctgaaaatagagtcagggaagggagatggggtggggccgttttataggatttggataggtaaaggaaaaaggggggttgttctctggttggaggagtggggggtcacaaggttctcagtaggggagcttttgagccaggatgagccaggagaaggaatttcacaagataatgtcatcagttaaggcaggaacaggccattttcacttcttttgtggtggaatgtcatcagttaaggcaggaactggccatctggatgtgtatgtgcaggtcacaggggatatgatggcttagcttgggctcagaggcctgacattcctgtcttcttatattaataagaaaaataaaatgaaatagtggtaaagtgttgggatggtgaaaattttgggggtggtatggagagttaatgggcgatgtttctcagggctgcttccagtgggattaggggtggcgtgggaacatagagtgggagagattaaactgaaggaagattttgtggtaaggggtggtattatggggttgttagaagaaacatttgtcatttagaattattggtgatggcctggatacagttttatatgaattgaaaaactaaatgggataagagaaggagaaaaacaggtattaaaggactaagaattgggaggacctaggacatttaagtaaagagtgcctaagaaggttcagtatagccttgccagcaaagattatttatttacttcaagagttaagagtggcgatttggggatagcaccaagagatatcagctgtgatggcttggagaaacagtgtaaactggcagtgtaaacaagagcagggcaggtatgagtagttgagaacggtgaatatgagtatgactagacagaagatagtagagatggcaagttttctggggcacagtccaagttggtctagtgtctggaatgagactggggcctaataaaaaggagcatctatacaggagctcaaatgggctgtaccttttagcattctgaggacaggcctgaattctgagaagggaaagtggtaaaagtattgtccagtcctttttaagttggtggctaagcttggtgaggtgtgtttttaaaagaccattattctgttctttcctgaagactgaggactgtaagggatataaaggtttcactgaatactaagagcctgaaaaaatgcttggctgatttgactaataaaggccagtctgctatcggactgtatagaggtgggaaggccaaaccgaggaattatgtctgacagaagggaagaaatgaccatggtggccttcttagacactgtgggaaagtcctctacctatccagtgaaagtgtctacctagaccaagaggtattttagtttcctaactcagggcatgttgagtaaagctaatttgccagtcctgggcgggggcaaatccctgagcttgatgtgtagggaagggaggggcctgaataatccctgagaagtagtagaatagcaaatttgccagtccttggtggggacaaatccctgagcttgatgtgtagggaagggagggggcctgaataatccctgaggagtggtagaatagcagatggaacactgagaagttatttccttgaggatatatttccacgatggaaaggaaatgagaggttctaagaggcgggctagtggcttgtactatagcatagcctgcctttgctggtgtgtggcgattaggcctggtggaactgccatcaataaaccaagtgtgatctgcgtgagaaacagggaagaaggaaatggggtgaacgtcaggtggatcagagagatgcagtcatgagggtcaggtgtggtatctggaataatgtgggaggccggattgaagtccgggccaggaacaattgtaattgtgggagactcaacaaagagtgagtacagctgaaggagccggggagcagacagtatatgcgtcaggtgtgaggaagaaaatagattttggaaattatgagagctgtagagagtgagttgagcatagtttgtgattttaagggcctctaaaagtactagggcagcaggagctgctgcacggagacaagatggccagcctaaaacagtaaggtcaagttgtttggacagaaaggctacagggtgcggtcccagctcttgtgtaagaattctgactgcactaaccgtgcctaggaaagaaaagagttgttgttttgtaagggattgaggtttgggagattagctggacacgatcagcagggagagcacgtgtgtttttatgagaattatgctgagataggtaacagatgaggatgaaacttgggctttactgaagtaaagggggctgtctgtgaagccttgcggcagtacagctcaggtaatttgctgagcctaatgggtgtcagggtcagtccaagtgaaagcgaagagaggctgggatgaagagtgcaaaggaatagtaaagaaagcatgtttgagatccagaacagaataatgggttgtagagggaggtattgaggataggagagtatatgggtttggcaccacagggtggataggcaaaacaatttggttgataaggcgcagatcctgaactaacctgtaggtcttgtctggttttaggacaggtaaaatggggaaattgtaaggggagtttataggctttaaaaggccatgctgtaacaggcgagtgataacaggctctaatccttttaaagtgtgctgtgggatgggatattggcattgagcagggtaagagtgattaggttttaatgggatggtaaggggtgcatgatgagtcactaaggagggagtagaggtgtcttatacttgtgggttaaggtggggagatacaaggggaggatgtgaaggaggctttgaactgggggaaaaggtggcaatgaggtgtggctgtagcccaggagtagtcagggaagcagataatttagttaaagtgtctcggcctaataagggaactgggcaggtggggataattaaaaaagagtgcaaaaagagtgtcttctaagttggcaccagagttggggagttttaagaggtttagaagcctggctgtcaatacccacaacagttatggaggcaagggaaacgggcccttgaaaagaaggtaatgtggagtgggtagcctccgtattgattaagaaggggacggacttaccctccactgtgagagttacccgaagctcggcatctgtgatggtcgtctaggggcttctgaggcgatcaggcagcatcagtcttcagctgctaagccgagaagatctgggaagtagtcagagagccttgggccagagttcaggggctctgggagtggctgccaggtaaattgaacagtctgattttcagtggggtcctgcacagttgggacacagcttaggaggaatcccaggctgcaggcattccttggcctggtggccagatttctggcacttgtagcaagctcctgggggaggcgggcctggaggaacacttggccactgtgattgaggcatttggaagttcttgtgtgctggagatgtggctggggtttgtctcacagcggaggcaaggaattgtacaccttgaaggtgaggttaattaagtcctattgtgggatttgagggccggaatttaatttttggagttttatttaatgtcgggagcagattgggtaataaaatatatattgagaataagacggttttttgaccttttagagtctagggctgtaaaacatctcagtgttgctgccaaacgagccatgaactgggctaggtttttatatttgatgaaaaagagcctaaacgctatctgatttgggataaagaaaaaggagcattaaccttgactaggcctttagctccatccacctttttaagaggatattgctggacaggtgggggagggctagtcatggaacgaaacagtaagccagaccgggtgtgaggagggcaggtgataaaaggattatagggtggaggagtggaggctgaggaagaattgggacctagctcagcctggcgaggaggggagaggttagatgggtctgtagaaaaggaagattagaaagactcagtgatgcttggggttgggactgaggggacaggtgggagggaaagaaggaagatttgggatgaggtgcattgggaacagagactagggagagacagatgtgtaaaagaacacctggatgtcaggcacctcagaccatttgcccatttcacgacaagaattatttagatctggtaggatggaaaaattgaaagtgccgttttctggctatttggaactactgtcgagtttgtattggggtcaagtggcattgcagaagaaaataagatgcttagagtttaggtcaggtgagagctgaagaggttttaagttcttaagaacacaggctaagggagaagagggaggaatggaaggtggaaggttgcccatagtgaaggaggcaagcccagagaaaaaagagtagagacacggagaaggggtggggagttcttgccctccaaaaaagcagagaaggggtcagggcatggagataagaggtcacggtatggaaataagggatcagggtgcagagataagaggtcggggttcctgcctctcccccagaaaagcgggacttgccgctaagggtgaaggaccaaggcaggtgtccctgtgtggtctgacacctctgaaacctgggtgaataatcagagaggtgtccctgcagtgattaaacaccaagggaaggctgccttccctagtccgtgaccggcgccggagttttgggtccattgataaaacatgtctcctttgcctctaccagaaaatgaaaggaattgaaattaagagaagggagagactgaagtgtggtgccaagattgaaaggagaaaaaggttgagggatagtgagggaggttggagaaaagagtaaaaagaggctacttaccagatttgaaattggtgagatgttacttgggctggtcggtctgaggacctgaggacataggtggatctttctcatggagcaaagagcaggaggacaagggattgatctcccaagggaggtccccccatctgagtcacagcaccaaatttcatgcgcgtccatgtcaagagaccaccaaacaggctttgtgtgagcaacaaggctgtttatttcacctgggtgcaggtgaaaagggagtctgaaaagggagtcagcaaagggagataggagtggggccgttttataggatttgggtaggtaaaggaaaaaggggggttgttctctggttggaggagtaggggtcgcaaggtgctcattaggggagcttttgagccaggaagagccaggagaaagaatttcacaagatagtgtcattagttaaggcaggaacaggccattttcacttcttttgtggtggaatgtcatcagttaaggcaggaaccggccatctggatgtgtatgtgcaggtcacagggtttatgatggcttagcttgggcttagaggcctgacagtttccacatatatttgaagtttctttcatatgccatgcactagctgaatgaaacatagacttggccatttcaaagttcacagtgggaattgatatgtaaacaccaaagtatgatagcaaaagtatgaaaattagattcacaagctaaaatgttaactacagactaaaaagcaaaaggctcaaacaaacaaacaaatataccacatatttaggttgaaagatgctaaagtgattaagccaatcttacccacatggaatattcatgcattagaccggagaaggtgcagatacagatgctacactggagattatgtataaaaaaattctcagaggtgttgcattgatttcctattattgccataacaaattaccgtaaattcattatcttaaaacagcatgcatttattatttcatcgtctgtagttcagaaatttggcatgggtctcccagagctaaaatcaaggcactgtcagggctatgttctcttctggacatactgatttcctttcttttggatgtatacccagtaacgctgaatgctggatcatatggtagttctgctttttaaatttttgttgaacctttatattgtttgccttatggctgtatgaatttatattcccacttacagtgtgcaaagtagcccttttcttcacatcctcccaacacttgttttcttttgtcttattgttaatagccattttaataggtgtgaggtgatagctaattgtggttttatttatttttatttttaatttttatttatttatttatttttgagatggagtcttgctctgtcacccaggctggagtgcagttgtacaatcttggcttatttcaacttcggcctcccaggttcaagcaattctcctacctcagcttcctgagtagctgggattacaggtgcatgccaccgcacccagctaatttttgtatttttagtagagatggggttccaccatcttggccaggctggtctcaaaagtcctgacctcgtgatctgcctgcctcagcctcccaaagtgctgggattacagacatgagccaccatgcccggcttcattgtggttttaatttgccattcccagatacttagtgatgttgaacaattattcatatacatgttggccatttatatgtctctttttgacaaatgcctattcatccatttttaaattgtcttgttttcttgctattgagttgtttaaatttcttatatattttatatgttaatacattatcagattgatagtttggaaatgttttctcatgctctgtggattgtctcttcactgttgattttttttcttggctgtgcaaaagcatttgttcattgtaatcccatttatctatttttcctgttgttgtttgtgcttttggagttatatgtaagaattattgcccagatcaatgtcatggaggttttgtcctatgttttcttctaataattttatagttttgggtcttacatttaagtcttaaacccattttgacttcattttttgtatatgttgtgagacaaaggtccaatttcattcttctgcatgtggatatctggttttcccaacaccatttgtagaacagactattctgttcccattgtgtatcttggaattgttgtcaaaaatcagttgactgtatatgtgtgggtttatttctgggctttgcattctgttccagtggtctatgtgtctgtttttatgccagtaccctgtttttaggctactatagctttgtagcgtattttgaagtcaggcaatgtgatgctcccaggtatatttattttgttcaagattgctttgactattaggggtcttttttgtgttccatacaaattttagaattgttttttcttattctgtggagaatgtcatttgtaatttgatagggattgcactgtgtctgtaaattgctttgagtaatatggatattttaacaatattaattattccaatccatgaacatagaatatttttcatttatttgtgtcttcttcaattctttcatcagcgttttatagtagtcagaatataggtctccccactctttggttaaatttattcctttttttgtagctattgtatatggtattattttcttgattcctttttctgatagttctgtggtagtatatagaaatactatgcattttgtatgttaattttgtattctgaagctttactaaagttgtttattagttctaatggtattttagtgaagtatttagggttttctatgcacactctatatgattctatatatattttctgtcattcacaaacagggacaatttaagtttgccccttccaagtttgatgccttttatttctttctctaattgcccaattcctctggctactaataacactctgcctgggattttctagtactctccttcagtattcatcaggtctcagtccaagtgttacctcattagaaaaagattctccatctaattcaattagaaaaaaaaattcatctaattgaattaccatataattcaaaataacctcccaattcaatctctatcccttcattctttaaaattttccttacatctcttatcattcttttgctcacttttctgttctcttgtatacgctcttcttgtatcccatcttcctctacattgtaaacttgatgaggacaataccttcactgcatgccttgttcgttattgtgccccgaataccgagtccatggttggcacacaataaatatttgtttaactaaagcatagcttgtatttaggggaagttaagccagttattggatagatgccatgccactggcaatatttcaatgtaatatctgaaggtaagattgcatctgcaatatcatattattctctaaaaatctgaacaaagagatcctttgatgatgattttattcataaatgtttgttttcttctccaccagtactgggacagaaatttgcatataattggcactccattaaaattgcttgcattatttcagcctagggtaaatacatggtagctgtaataaaacctctcaaccacaacataatccgaatagaaccaaccttcagagatagaggaagatgatcccaattgtctagtgattgcaaaattatattaaccttaggtaaagtccattgtgtataaattatggtagaagcttagtgcaggagaatgaacaatagttttagtgtcagaaaatgtgagttaaattcccagcttaccttattactggacctatgacttgaggaagttttgtgggttttttctcttttgtttatgtctctgaactttggtttcctgaataggatagagccgaatatttaggtgacattagtgaaaagggaaaatgtgagggggatgcataatcacatttgggaaactgtggatattcttagaacagaaaaaaatagattagtgaggttttgaatctttccacttatcttggtaaggattatatgccaaagactagttattgtggccatactctttttccattagtggcattggagaaccagaaacatgggatccaaagagaagcttagcaatgttaagtcatgttaatactaatttaatttttgtttgccaccctacccccaccaaaaaaaaaaaaaaaaggttataatgtgattgtcacgacagcatggggctgtactgagctttttgtcatgatattaaataggcttctctgttagaaaaagatttctggtctaaggacccaagtagatcatataaacagaagtgtgctgttatggtggaggcatattcatgttggttctgcattcacagtgaacatttgtacccaactcctaagacctactagagatcaaatgtgtttaaattgagtgtactcagatagaaagatattctgaaatttctcagctcttttctctatattgttgaaaattatcttttacaatgcaaagcctctttaacttgtaaaatatattattatactttgctttgagtaatgtgcaagttaatgtccctcccattccaatcataacagtccctcagccaactgtaaaagatgctttaatgattattttctttacttaatgtcttttttcatctagggttagacaagtagagctggagtgccttgcctatgcgctatcgttcgttttaaagattcttggggagttaaaaataaaagaaatttagaaaaaagaaagttgaaagttaaatgactgtattaacatagtactaaccagtaaattaagagtgcaatgaaataaaacaaaatttcaaattcaaaatggcttatgtcatgaaacccttaaggtattttaaattttcactgtatacaaaattgtacaattagcaaggaacaatgtgctaatgggttttaaatattcattttaggcttatagttttcagtttatacattttttggagagcttcaatacataaataccacaacaattcatttaaaatggtattttttagtttcctaaatgatttggatgcccaagtctctttctataaaagaatttcttagtataataattaggcaatagttcaattcattccaaatgcctagtaaaatttctcctaactattaattatatcttaataaaagcttccaagcgaaccaaaatttttttgtttcaaagggttataattttactgatcgtataaaaagaagctaagttaaagacagcaaacctactgggtaaatggaattctgatctcattctctttttgcctaagtgtgccagagaaagagtgaaaatgatgagattggtgttaaggaaaatgtttttatttgtgggcacatgatggatttctcttgatcttttccattttgctgtcttttcctcctggattctgacagtactaaatattctggtaccattctatccacctccagctcattaatcaaactctaagtttcataagtttagaggttgtttattattctttcagtatctccaacagtatatgtaacatatctattatttagctacttgacacttaaataaatatgtatatgtgcacatgtgtatacatgtatttacatatgtgcacatgtgtgtatgtgtattgtataataatagaaaattttctggtctttgtcccagattcctgggatagaacttctaaaccccagacatttcttaagggagaggagtatttgtgttgttcatgatagtctctgggtttatgcttataaggtcacttatggtggacttttagatagcttatgttaacaagatagctcagcatgaaggcagactatgccagaaaaaccaaccatgtaattagaaggttggtgctttgaaccagatgatatcagttcaacctctgggcaagagagatggattggagattgagttaaatcctgtgcaatcgcactgcatagcaagactccagtaaaaactctggacactggggctcagatgagcttcttggttggggacacatcaatgtgctgggagggtgacatggtcctgattccatggagagagggccttcaagaccctcctagacctcttcctctggcatctaaaatgagagcagtcttgttggggactatgcccttgatctgtgggatctgcactaactctgggaagttactgacatagttgacttgcagtattagataatctgtgttaaatatgtgtgttaaaatatatgaatatttctatcttagagtcgctaattaatagtggcagcaaagattctcaatccttatggtttggaaaagagatttacacctttaccatgaagtgcttttattgtcttgcccaatctcagaacaaaaccaatacacagttagcactattaatcccctcggaaaactattcttctggggtttgaggaaggcttttaagaggttttactaccctatgtctgataaaatactagataaagactgcatgcacaggtttaaaacttgaacagattttttgggaaaataagaagggcttaaccatgatttctattttgtccttcctatgtcctcttccattttatggcttaggtttattaatttcccctaccttttctccatataatttccttttccaaagaatggacattacatgctcattttcactaacatgtaaacaatgaatggtgctttagttgttctcctccctctgagcagagttctttttcattcccttatcaatatgtcaagaagccccactttctattttgactctacaaaattgtttctcataacatagttggatgaaacaggcctgcctcctgtgaactctgtctcctttgttctctttataaaagtaggaaaacagtttattatgtcagacactcttttaaatgctttgtatgtattaggtctttttaatcttcaacaaaccaggaggtaggtgctatgttaatcttcactttatagatgattttgtgagacacaatgagttaaaagcatttactcgagaaaatttagctagtaggtgacagaaccaagattgcaatcaaggttatttgattctgaagtccatactcataaattattgagctatgctgcctcacataaaatgcttctcggtgctggagaactgtgttcttgttctatcctaggaagagaagtttgtgaaacatttgaaaaaatttctcctatttccacagtcttatttctcaggactttcccatatgttccctctttctactatattgaattcttggttatttcctaaatgccagctactttttgcaacttcccacttgcttttttctctgcttgaagggcccttctctatttctctttgtcacttacttctactcattcttcaagtcagcttcaagctttccataaagcccagtatggggaagtaaccatttctctgtctctcatcagtatccacatacttttatttgggcacttaccataatctgtggtgacccttccttacttctgtttacctcagaagactgaaaccaacctgatagaggtcttttatcttacatttctctatctctagtcctagcacaaatttgagaacctaataactattcattaaaagtttgtaaaccagagaacaaattaataaaaccagataataacattgcaatatttctgaaaccaaggtttgtaaccaaagatttttaatttttttatatcctaagaggttctaggtattgcaaaaacaaaacaatactattgtgaacttacttaattgcatctgaaattttatcttaatcccagacattggcttaaggttacagtgaaagaaaaagtaggtaaataatttcatcgccttacccaccctttcgtgtttttaacacttcaaacatacacccaaacacacaaaaacacatacatattgccatgtgtatactatggatatatatacttcgtgtgtgtgtgtgtgtgtgtgtgtgtgtgtgtgcttgtgtatgtatatatttcctcattcccctgcgtggaaagtgacaaagtatactatcatttaaaattactttcttaacatcatgataaaatcaaaataaactgtcacttttaaagctttgtaattttataccccatcatcttaacagctatgattcacagagttttgagagtttttaaataatgacttaatctttgattttgaaattcagaaaaaaaatcaaaaggaatggatgtattcatgattgcaaaagaacaattttatttatgaaaatactaacatttatctctgtctgtatatcttgagatctctcaggatgtatgactctgttttgcagaataaaagcctttgctgtatgatatgagtgaactattctaataatgaaagaaaatccatgctaaccttaaatctgtataactgcatagcactgaccaggaaaagccaacttgaaaggtactgcttatagaagcatgtcagcccctattttatggtggatcctgtcacttttctcaggagagatgtctggatcagtgtgctaagtactctcctgtttctaaaaattcccaaagaatgtctaaaatcagtagttcacagtttatgtagatcataatacaactgacatctgtaagctgtagaaatagatacacactgacatggctaaaaagtacctgctgtttctgtgaagagaggccgaagttttctctaggaaacgtactacatagatagtgattagtattcctctagatacctctggcttatcacagttgatattctcttattatgccttcttcattggggtacaattcagattttatgtaaatgcataccaacagggatattactttacttcaaatttgagtttggttatagaccaatggttatataatgttactacttcactaattttataagttgctaataactttctatgtttatgtagtatttacataatggatggaggttatctgccaatagaaaacaacaaatgccatcaggacttagttgatagtgaatcctgtggtaagagctttacatgtgattgttcgtaagttcttatttcaattaacaggatgagtttaatgagattacaaaacttgtcaacttacctgggaccacacagctagtaagtggcaaagccaaggttcaaatccaggacttgctaattccagtgcccatagtcatcattgttatgtaaaactaccttctttactgcagatatggaaaggctttatactacaaaacagtaaataacagggaattaatgatggctgcactgtagagaaactttttttttaatgttttgaattgcactcgatcagatagttggtttttatttgccaaagaccagtatgatttacaaattcctccctattatttcaaagaaaacacagtgtgatttccaaaggtaaggatacaatcatttctgggaaatactagctggcatttgcagagaataattttgaagaatacacactttcttgaacactggtgtggcctaggtctgggtagtagaaaactaggaataacagtagctaatatttcagatctgcgatcaatgaagtgaaaatctaaacatgggcaaaatgatgacagagaccaaaaattatgtataaaaactgtgataataaggaagtggtgaccagaatacaaattggaaccatacggatcattgaagcacgttcatgaatagtgcaaaactatgatgatgaaaaatgatttaaatggagcaatgacagatgattttgttatcctatattggcaagggattaaaattaacacctgaatttaactgtattaaatattttcagcttctgattatatatatgtgtgtctacacatatgggttatatgtatgtgtctacacatacttggctacaaaactgaaatttgtccttcaagttagacccttacccttagtgtgccccaaatctacctgcagcctcctgtggaaaaatggccagagttttctctaggatgttatatagctagtgatgaatttttgcttcaaagaccttagcttactgcatattgtctggtaagctgcttatcattcctttcaaaatatagtttcaaacactgtcaatgaagtatttctaatgtgaccgtaaagtatgaaagaaaagatccttttcagttattgttaatctatactgggagggtccgggtgacaaatgcagaacaataacatgctcagatgaaacagaccaggaaaatgaaccccttactaacagggaacacatcaaggcccattcctgtcttggaattaggctagttagtttacactgcatcatgtatttggctccatataacaattgctgttggcgcccaccagaatctctaactcatttttatttcatctaaccgtaaaactattgattaatacatttgttattaatcaatgaaaaaatggtttatcttctgtgtaccttctagtcctcccctgcatttctctccctcaactctcaacaactcatctgcttttaggatattttatgagactctagttcagttttcacacagtactcttcagtttggctcatccattcctttttgtggagactccttcctatcttccccttttcttcattgttggtaatttatttctaggtcctgtcctcatctatcctagtagcaaatttcaacagaaacttagttctttttatgtttgatcatgttaaatttttgtttataaatcaagggtattttaataataggtcaaatatctaactataaacatctaaatatacaaaataagaattagaaaatgttcatgtttgtttaataatattactactagtagtattaaattgtgattcctagagcatccttagcagcacaaaagtgatttaaaaggaaaaaataattttaatgtcatttccttgtagcacttctgccttatttttaaaagactttaaagaataactgccaatgaatttaataatatcaaagcctatcttgttcaaccacatatggaaaaaaaatactaaaaatgaaatttgactgaggagtcaagcaattttatgatgttcttcttctattaggtaccagcatgttatgaagaataagcaagaagaaagagaaggagaagaagcaggaggaggaggagagaaggaaagggaggaggaggaggagaaaaagatggtggtagaggaggaggagaagaagaagaaggaggagaaggagaaggagaagaaggagcaggaggaggaggaagaagaagaagaggagaagggaactcacatgtaagttacaggtatttttgtattcatgttatacattaaagaagctgaaattaaacaaacaccaaacctgtattcaccatataatatccttactttccttttagtctctgctgtaatttctctgcacttttcaatcatttaattcgctatcagaatcatgaactcaccattttgcctaagtcaattttgttaaagttgtattcatctagtcagatttcctgtaggttaatgttgagtgtatatctatcctttactgtcttagtataagtcattatttgcacagctacctatgattttgccatttgggttatgacgaaaaggttagttccaagttctatgaggaataaagttctaatggcctacttctattattacattaagaggtatggaaactgactatgcagttttcataaactcatttaatgagaatgaaaatattcatcattaaggtcattgaaagaaaacagtataaagtaaaagcttctgaatagacagaagccacaaaattcccaaattatactctttagaaatttttaactatacattattttagtgtctctgaaaattttaaaatacccctttttcatgttttatattcatccctgtaacattttcaaacaataacatattttataaaacaaatagccactgtgaaacaaaaatactttctagtttttattttctatatttagatggaaaaagagtaaactttttgctatgattataatttcttcatttgcagttattgatgaataataattatcactttagttttatacttaattggcatatcacattgggtaaccgactttctaagtcaaccatccaaaagccaacttaatgttagctacaaaactatctgattgaagttcatggagttttaaaaaccattaacttttatgtgcagagtgaaaactttgctccactggcacataatttcatttttatagtcaggagataacaataacatgaaaacattactgccaatggaaatatgcctcatgaaaagtaaaaagtaaaagaatatgaaagattagttattttgagataggtggctttgtatatgttatagaaagcaagaacaaaaatgaatctaccctaggtgattggatgaccatggcacttgaggataatacatagaatataatttttactaaaaaagtacaatggtcaaagcattcaaagtttttctcaataatgcacttgaaaattctctgttctgtcatccattgatatgaaatggtgaaaagaggactttaaaaaagaatagctaatttcctgaataatagatggaacttaacgttatgtgaaccaacgttgacagtagtgtctaaattaatagttagcaaagtgtttcctgttcttcactgatctttgcaattatctgcaccagatcatttactcttattacagctttttacagcttctttccatgccattggggacattttcctcctcaagttgtctccagaaaattaactttgtacagcaaagccctttagaattattattatttttttccagatttttatgcatgaaaataatatactgctgaaaactattattggttctcaacattttcttatattgtgtttttaaaagtcccactattagataattttttaattctttggtactgttacacagggtaggaagaatccttctgaggtatttattagcagtgatataaatacctgatccaaatttatcagtgctaagggttttacagatattttaaataatgaattgtgtatagtgctttccttttcactaatcccttcaggtatattatctcatttgatctcctgagcagctatgaatatcaattttgttatttacaggtgagaaagtggaggtttgaagagattaagtgacttgctcaagttcacacaatttataagtagttcaattataaagcatttatcaggcatatgctatataacaggtagttttctaactcattaggatattgcaaacaattttttaagtacctacacttgcaggattaatcacaaatgtgcaaacaggcaggtagagtctcaaatatgtacaatgtaaaatatattcaaacaacaaaagtatagagatgtaactaattgtacttcttgcaagggtcagggactactttatagagtggttggtgcctgaattacattttgtttggtaaatatgagtttgtcagataaatgaagggagaaatgtaccaaagtagattttgtaacctacaatctaacatactctttactatataacatcacctctataccatgctatattgattttctattgatagtataaaattattactataaaatttagtggcttaaacaacacacatttttatcttacatttctttagttcagaaatttgaaatgtgtctcattgggctaaaatcaacatgtcatctaggctgtcttcctttttggaggcactaggaaaaactcaatgtccttattcttttccaccttccaaagaggattcacattccttggttcgtggctcccttctcccattttcaaagccagcaacagtggattgagatttaatgtcccatcccaccgaccctgctttagttgccgtcacatctctttctctgaatacaggcaagaaatgttctcaacttttaagaagtcatgtcattatactgggccaacctggattgtttaggaaaatatccccatttcaaggtccttaaccttaattacagctgcaaagtcccttttgtcttgtaatatattcacagattccagggattagaaaatggacatatttggggggtgggaattattctgccgaatacacgtgccatttgtaatcttaaattatttcttgtctcgcatggatttaagcagactttcttacctgtaagaactagattattatactgatgatgttacgtattttgcctatgacacgtcaaaaaagaggggtgaggaaagctcacatttttacaccattttctatgatcttagagatgtcattttttaaatatgcagttttagaaaaattcaaaaagatgaagaagaggtttgatcattctgtatgagctcattgactcaggtactaaatatctttcttgtttgccatgctactatttcccaataactaaaaaacctttatctttagcttagaaatttctcctcatcaatccaaatacctattgatctacaggactctcaaacacaaaacacttcatgctggcctattatctatactctttttctacttctactctttctgttctgctcccaacatcagagaagggcaaaagtatcccatcaattgcaagaaccataatcctggaagtcatcttatctacagtttcaaacaaaaaccaaccaaatgctagaaattttaccaactaaacatttattaaatcagtccatatttctctatacctattggcatatccttaattcataatctcctattttggttatataacaaatcactaattagaccctttgtctcaagcttctctcctacttctctctatttaagcatccaggctacagccagaggattcattctaaaataaaaactcactttattaactgtcctacttcaaaaccctgtaatggctgactattctctctagataaatacccaacttccaaaataccctggataattttaatttcccttagtgccctgtactctttctcgctgtctgctctttgttcatattatctcttattactcccttatcctcttctttcttctgctccaaacatatttcttgctctttattatgaaatttaaattatcacctcctctagggaactcttcctcttccccacagctaggctctgctttacttccttggggaagaaaatgcattggattaaaaatgagaaagaaaggaacatttattgagacattatatgctaagattttgtcctatatgctttaaatataatatacgctaagtcatttgaaaagttttgtgaagtggttattagagaatttacaaatagaaaagctatatggtatgtgaaaatgcagaatggagtaatctgggaaaagctagctggctatggagacacataagttgaccttgattcttatgtcttcatagtcagggcttgcctttcattcatgcagtcttataaagtttcatcaggtttcccaattggatcagattcagagatgctatctcacactaataaagttcttatgaaaatcatatagaaataatttaatttactgagatatttttctcagtactcaaactactatgggaagtcacatcagcaaagctttgtttggtacacactagaaaagaaatagttgttaagacttaaatgctcaatgcttcaagcaaccctgtccatttttacacttgcttatttgtccagagaatcaaatgtttaggtcagcctgacaaagtgcctcttaccctgggcaatgcatgaatggtcattgctgaaaattgcctaggtctcttatttttccgtgtctttggactgaccaacctaaaaccaaggaagtgttctcattctttagatgttattgataattatcacagggtctctctgagtacagaaataacttcactattgttcagttctgatgcatttttttcagattgtaatttgaagaaggcaggtttgtttgctttattaatatcttccatggagctctgcattattccatcttatcctgtaactctttaagtttcaactctaggtgttaataattctgttttacagttggataatttatgcttgagtttagtaacttttcttaagtaagaggtggcattcaaagagagttcctctgactccagagcccttgctctttcaagctttgctcgccagtcttagctctgtttctaagtaaatgtttgccattggcagatcactaactgccctctgtcccaccttgcttatcagaagggtgagatgttgctctaaattatttataaaatctcttccagcttgatttattaataaaaggcagtattatttccctgctttcctaagtctaccaagtaatctctttcacaatgcaaagcagaaatatgctatgaactaaattcccattccagctgcccagatactggcataaggttgactaaagtcgtatttttcagtattgtgagctttcatcttttttttcttctttatggttaatttaatgagaggttggttggtcccatttcttatacaggaaagagattagggtttggatagctccttgagctgctttttaattatctcagatttcacatttttaaagaagaaatggctgtaacttattcaagaggaataaaattctgtgatgtacattataactatagtagatcaaaggcctcattttttgcactgtgcaggtgtagaatttctgtgacagaggaggatccacgataggcagtaaaaaagggaaaacaaaattacattggtttcacacatttgctttgcaacatctgtttaggtggaaagcattttgcctgtcgatttattgaggagtttgttcatgacaagccatgtctgtctatttccctcgttattttgaaagctttgagtccaaagggattgaagtagcctggctaaattgcactgatgccagtaaatagtgactttgtatcaggggcagagtgagcatctgcttttcttagaatgctggagcaagtgtgatatctggggacagagaggtagaattggactgacagcttagtttttctgctgccctgaatttactaaagttagctgtgaaaatagcccaacttaatcaatgtaggccagtttgtcatatcattgtttcctgtgacattggctgttcatcaacacctgagacctcagtcagtcagtgcttcctccccacagttcacgcacacatagctgatggactaccaccttcacacagagatctcttaaataaaaatttaacctaactttaaagtcctatattgacaaaaagaccatatagctgttctgctaacaattctggatatcttcagcatccagcgagtaacttttttcccttagggagaatgaaagggaagtaggaaggatttttgttactggttaacaaaaagtcaaagtactattttacagcagtaaccaccataaacagaaacaaacaaacaaacaaacaaaaacccagaatttaacaatcccttgcactcctagcatccaacccatcattttacaaatcactttgagaccaggagtgggtgaaccaattgtaaaggaaccccagccatcatatattatacttggtataatataccatgtatattacaaatgattcatagtagctaaaatccgttttttagaaaagcatagctgtgtacatcttgagatgcaagaccaacactgaaaaattctgagtgatatttctttcccccccaccatggtttaagacaaaggaactgggagtagaaagaagtagtgccaattttaattattgtcataaagtcaatagcaaacttcagcaaaattatcatctcaaagatgtgttttggacgtgttcttctctgtatcctatcttcaaacatatttggaagcactatttatccttactaggtcttcagaggggagcctggaaactacctgattctttgtagaaatagaatctgaccttattgcttcccaatcaaagagtgaccattatcttgaacccagttggaaagctgattactttattttcttaaatcagtgggtacactgtactcagatgcctttattttattgcttgtctagttttccagatgtcttactaatgcataggcaaatgtgttcaatagattcagtgaagtttacatgctttccagagagatacttaactgagtcagttactgggcataatgtgtcataccctgggtctttgaaatgtgttatcacagatactctaagtcaggaattagttgtttagctcaattgcttccaaatatacaacattctatttgtgtaacataaatagcaagcacagcgggcaaaacagagagactaattgagaagcccttatgtttaggacaaattctatcaatgcaggtgtatggtatattaaagagagatgaaagttttgcttagcctagtcacttgtatcaaacatatttttttttctatcacaatgctggatctctttagagaattatttatttgctcacaaaatcttgtcaaaattgggtatcagtgaaatgaatataattattaactctgaaagttaacccatttctgcctgaggttgcaattctttgaatttttgcaatcagaccttggcgatggccttgagcagtaggatataaataattcccacatgcttaatgttccaataatggaacactaggcataaatggctactcctgctgggtttattccaaaagttgcatcaataaaaagcatttcggggaggggtcaccagtaaataagttgaaaaaaatagtagaaacataatcctagatatagagaaagaaagaaaatatgagtggggaagggtttttggaaatgtctatacttctctacagtcaaaaaacattcatcccctactttaaataaaacttcctgcttcccataatttgcatattctactattcagctttgccactgagaagctaatattttgtaaagagtttctttattaattttgggcttttgatataataatctcatatttgctgaatacgtttactcttaaatgacagttttgtcattgttgttgacctgaagcagggtgtatttttaatgggagatgtgaagaaaaatggaatagaggcaaaaaagttattacccagttaccatttttagaaagtcattttaagtagttggaaagcaattctatttgttccttcattcactgatgagaagatctccatagtgaggaagttgtgagagggagggattaaaattaggcaactattttacaaaacaatacttgcgtgtcactttgctcagtaatgtctttttagccatgtggatttttagttcatcaagtctaattctcttgtatcctttattgcaggctacctgtgtgagtcacatgtcagtgcaatttctggaggtcaattgtagccctgaagtctcagaacaatggcaaaaagaaatacggagggcatgatacatttggtaagtgccttatgtaaaccacagaaaatgatagaggcaatttttttctttcctaaggctggtgatttattgcatacttcttgtcacggaatagataacataggaggacaggaagaaatttgctagtttacacagtgccccctgaaaataattcatcgaattgggctcctttggaaacattcacatattctgcatgtatttttaccagacacatttagcatcgtaatggcataataaaagctatcatttgggaaatatacacattgctcctatctgagtgcacagtggtgttggtaggtactgagggaggaagagacacatgtgccctgaggaagtctctgttttgtctccatgcacatttaagtcttttacacatttgagaagggactgggagaggagcatgggggaagggggctggatgtggctggcatcttctaagatttatgaactgctaaatttagaaatgtcattttgttattgccagtgaactgctagcatcttcgtatgagtcactaagaaaaaatagcaatcacctcctttgcaagagctagtatgagtaacacaagatgggttcaattaatcattttaaccactaaattcactctggataaacaaagtgtgtatcagatgatgtgccctagaaaggttgtcatccttacaaaatgctatgctctgcagctatgctcttctcattatcgtattgcaaatagttctctgaaagaaaaaactgttcaaacaaaatattaaacagcattcatttgtcattttccttcggggactaggcagcaacctgctgtggctgaaaatatgtggtcattatgaagctggtattgaattgtttgtttatctttagcaggggagggaggtttcaatgatgttactatttgattggtaatttcaggcacttctgctttctaaaagcgtatcctctgtccagaattgatattaataaatgagtgtgtaaatatgctgtttgtatgtttctttttaatgttcatataattttcagtgtcataagctcttatcacctgaggagtgatggtgagttttattttcttgttagtgtatagggttttatatcacagtgagtcaggttgcttgctctttcagaaacctgaagcatttactataaatggagtgagtcaggatgtctaagatgccttgttcactgatgacagtatgactttcgcaagtagatcagagagagatttcagtgtctgcatgtggtgtgctatctctttcatctggtcacaggaagcagcaggcactttttttttttttaacgtagagaaacctaggttctgtttctcctctttttcctgattctccatcttttctttttttccttcccattttctttctctccatctttttcttgttcttattcttctctgcactggttaataatggattcaggggactaaaaagtgacatgagaaggtaataggctacacacatctactcaaatcccccagacagataagaacctagtccacttaaaagtaacttcagataccatccttatagaaatccatgccatcacttaacaacttttacaaaatcctttattctgctatttaaacctgcttccttttataatgtgcttagagagcacaagaaatttgtcaccattttctgaaacattccttactcagactgcaaaatcactctttcagcctatttaattggaagcagaattaaagcttcattagctttatctctaaactttttatcaatttatggcactcttcagagcctcctttgcagtttttcagatcctctttaagtcagagaatgtagaactgtacatgtgtctccaaaagatatttgcccagggcaagtcaatggtaaagttcaaaaatttttaaaaagccctattcatgttcttcaaactcttatggtcacatttgccaagcagaatatgtttagtaaaggtgaggatttgctagtacaagactctggtaagggagatgacttgactgccaggaaataatacagcatgtagaatagagaaaaaacatggctatccttggatgctaccatgtttatttcatacttaggagaggagaaaaaaagcaaactttgatgaagagcggaaagctgagaatcagtgagagaagtctgttttgttggggttgttacaataacactttgcctgaagaaagtactcaacctggatgtattctgataatattgatttgtgattctttccatctaaagaatccttttggagagttaggtgaggacaggaaagtgcagagatgtttaaggagaagagttagagttagatcaaaatcttacttattcaataaactataaagttgtttttccaggcaaaaggagacaattgcggattttattattgtctgaatgaaggggctttaattgctcagatatactgctatgcttccttgcctcattaagtgcaacagtctgatcttgcagtggggaaaaaaaacaggaagaaaagtaaatggggtaaaaccatgagttaaatagttagcttatagcagtatacatccaaaacgatgtattctgatctgttctctctctctctctctgtgtgtgtgtgtgtgcgcgcgcgtgtatatgtgatctcactttttaaaaaaggtttgctttttatcccttgcttcacaaaaatattgctgaccatccaacacagtaaactaatcgatacataacaaagatagaagccaccatttattcagatcatgctacatgccaggtacttaatatatttaaagtataatatatctagtatactttatgtaattacctaatataattattttatcatttaaatgtattaccatgaatgactaactatatgtcatgctctaagttaaagatacgagccctgtgatggaggcatttctgtcgttattttacagatgaggaaagtgaagtccacagaagagactagctacagtctcacagtttgtcagtggcaaaacttagttttgaattcaagtctctctcacactaaagttgatgtttttcctaacacattcctgttactctgctggacttgtcagatttatctggtatctcaaaagattcatgtaagagaaccagagtttttcatccataacactacctccaagagagataaggacactaaattgcaatgatgtaattaaacatttttggatttttttctatcagagaagcctagagaaggtcatttttctttaaaaaaaaaaaataaataaaaataaataaaagccagagataggcaagagttgcggcttctggaattttaattaccagtctattataaatatgtcatcttggcctataatgagttatcacaatcattaactattgttgcagttattggttgtaaaataaaatgcaaagtctcagctatttaatgtatgattaatacaattcattttattgggctcttacactgtgtttgtgggtttctttctctttctctttttcgtttttttttcccactctgtctctttccttgggcattttatgtgaaccacaaaattacaggtctgtgtcttattgtactttatggttcagtaaattaggccagggtgataacctgagggaatattaataatacttgttttaacaagcctacatttataccattgtcaggagttaattgctcagttatacccctggtgctcaggattactgagtactaaaggatagtggtgggaaggaaagtgttccactttggcaaaatctacttccctaagatttgtgtttctggcagcaaggagatgattaccctgaaatacgtgaccatttattgaaccaaaaatagaaggtgttttatataggcactaagtaatacttctaaggtctgaagtcctatggagcacatacagaaaatgtttgcaagtttataaagtgtctgactctggatatctagtaacctggaaaacactactattttattataaaactgtacaccaggggttctttgtcagaacagctcccgccagatgacaggatttatctcctagaagatgttcttttgttctttgtggtcaggcgcagtggctcacacctgtattctcagcactttgggaagccaagtcgggtggattgctcgagtccaggagttcaagaccagcctgtccaatatggcgaaaccccatcattactaaaagtacaaaaattagccaggtgtggtggcacatacctgtaatcccagctacttgggaggctgagtcaggataatcccttgaactcgggaggtggaggttgcagtgagccgagattgcgccactgtactccaacctgggtgacagagcgagcatctcacaagaaaaaaaaaaaaaggtattttctttgcgagggggaaaaggcagcaaatactttcattttgatcttctctatgctttcctggaggctgaaatgcatctacctgatattggactcagtttcctgagaccaagactatgtgttagggtcagaaaggggaatagctacaaaaatagatgatgagagagattattattagatagtataaccctctggaacttctaggatagtcacatactcacttgtcccgtttaaaagtgtaattaggcattttccaattggtttgctactactttcttattcaatcattatgttgtatgtaagaagagaccaaagctttaatgactttatttattttccttatctgaaataattaaacctatctttcagggaattatgctaactttttgaagtagcatatgtgaaagtcctagcatgtcatccttaagaatatgccatctacatggaatatgtgctaatatgattccttgtaccctgcacccctaaactattaatatatcaatgacttttccccctaagttttagtggaacttccacatcttcaggtgagacctctagacagtaaccaccaaatgattgtgagaggtgaagccagctggacttcctgggtcaagtggggagttggagaacttttctgtctggctagaggattataaatgcaccaatcagcactctggaaaaatgcaccaatcagcactctgtgtctagctaaaggattgtaaaggcaccattcagtactctgtaaaaatgcacaaatcagcactctgtgtctagctaaaggattgtaaatgcaccaatcaccactctgtaaaaacgcaccaatcagcgctctgtgtctagctaaaataaacgcaccaatcagcactctgtaaaatggaccaatcagcgctctgtaaaatggaccaatcagcaggacgtggacggggccaaataagggaataaaagctggccacgcaagctagcagcggcaatcctctcgggtagccttccgctctgtggaagctttgttcttttgctgttcatgataaatcttgctgctgctcactctttgggtccgcactacctttatgagctgtaacactcaacacgagggtctgcggcttcattcctgaagtctgcgagaccaggaacccaccgggaggaacaaacaactctggacacaccacctttaagagctgtgacaatcacttgcgaaagtctgcaacttcactcctgaagtcagcaagaccgtgaacccaccagaaggaagaaactcgggacacatctgaatatctgaaggagaaaacactccagacacaccgtccttaagaactgtaacactcactgcgagggtcagcggcttcattcttgaagtcagtgagaccaagaacccaccggaaggaaccaattctggagacaattggagctttgaaaactatttaactaaattatagtgggttcagtataaaagattgttttcttccctcccttctctttttttttttccttattcctatcctgctatagtattttctgccatgttatgcacgtacatttaaaaaattactcaccaatccaataaaaaacatactgctgccttattgtgccttggaatgtgtgataaatggtatacgatcaccaccgctattggaagtggtagagcaacaggaggtcagaagttgtagtcagactgcttcgagtcttaccctagctttactatttgctggccatgtgggaaaattacctgaaatatctaaacattaatttagaatgtgcaatgaaacatgtacaatgtagaatgttttcacatagaatgtcaaatgaagataatagaagctcaggctgacgacccagattttggggttcaaaccttgactctgccatttacttgttctgtgaacttgggtaagtgatgtaacctctctgtgcctctattttgttttctataaagtagattactgtaaaaattaaatgaattaaaacatgccttatgtttagaaaagcatctggcacacataagtcctcaatcaatgttagtgttcttgttctttgttgcttttattacctatcgttttacattacttagggaaatacatgcaaataataaatacttagtcaatgttaattattatgtgacaggtcctccccttacataattgacacacatttaaagaacaggtcagtatgggataagtattgtctgcatggtacatatgataagcactttgtgagtttagttggagggactatcatttcacagaaatgacagctaaatgtaaagacctcaaaaggctaagtagtggtaaagatgtggagctactagaactctggtataaatgtaaatatggacaattattttgtaaaaagcattcaacaacaatattcagtacctaataaagttcaaactttgtcttatgagctactgactttactcttagatacatacccaggaaaaatgagtgcattttacaacaaaagattcataacagctaaaaactggaaaaaaaattaaaatcagaatgatgagttaggaaaatatgtgaaatattcatatgaaatattataaagtaatgaaaatgatacgtaagttcaacaatatgggtgactctcacaagcataatgttcagtaaagtaagccaggtacaaaaaagcacataccataaggctgtttttatataatattttaaatacgcaaaattccgtggtgacatgtcacaatagtaattgtctttggcgaggtaagtagcaacttggaaagtgcatgagaagggcttctgaggtgccagttatgattttaaaattgcatttactttgtgaaaattgattaaccacaattttatgtgttcttttctttataggttttatttcaataaacactttgaaaaggaataaaatgataaaatcattgattgtttcagatttatctaacaatacaatttcggaaattattctaggttattggttttcaaaggctgaaacaaagtccagtatctgtaccttgaactacctggctttgactacacctaaaatagtaacatatttattaagttcttgaggtttataaatggaaggtttttttttttttaaacccaactgaatagtcttttaaaatattatttaaatggtacaaaattataatagctggaaatgatattttatcctctagcatcattaaaacttcttatgccttgccttttttgaggtggagtacagtaaaaagttctttaaaaaataacacaaaatatagccatcaaaattgacttttgatccactctgagcatatgttaaacctagcaaaaagcatgtaaaccaattcttactttaaagagaatattggttatgaagaggaatcttttagaaggttgaataatttgtcagtgatttgttggctacttacataccttgtaacaaattcaagaaatacattgggattctaacctaaagcctaacgatttactccctaaatgaatctaacctaaatcctaatcatttactccctaaatgaatcagatatattttcattaactggaatacttacacaaatcattgctttgcttggcaggtgcacaatttgagtaccccaggaaccaaactctaaaacagagtttagcatataggatgtttattaaatagtactcttgtaatcaatacctgtgaaaggaagaaagaagtagtcatccgtagagaaacgtcaagttgtgatgtagactcattgacagccatagttgttaccatgagaagttctggagctaggataaccctcagaattgttctaaattggactaatgatctgatatttataatttctcatttattaattttggatgcagtctacccagggaagaggcatttccttgggcaaggagactctttgcagctgagatagtcccttaaagggctgacagctaaagaccgactattgtcagcactcccagattctgggggaacaatttcttcattgaagggatatttgaccaacatgtggtcaaatgtggtgatcccccacagtccatctcttgcctgcttagatccttttcttcataaaatttctggaagcttcccagagactgttttagacatctattcatggagaaaatttataagcaagtttgtgggaagcaataggtactatcaccacagctgccctgggtgtagggggacaagtgatgctcatgatttctttcactatccagtctatattccattcactctctactaccatttctactggagtctaagggctctaagtccctagccaccacacctttctcaggctaaagttgttgctcttgtctattttcacaactaggcaaaggaataccagaggtacccaagtagaccacctgagtgtcacatacattctttcaatcttcactgtgtagcagcaaccccacctcttcctaagcatcatggtctattgcccctgccaagatgatccctgctattcttgcctgctgatctaaagttcccagttggcagtcacagcttacaattcaatgtgacctttgctgtgtcctctggcagaagtgtcctgcctttgggaaccaagacctttaaatttacaaagcctagaatagaaggaataggaaaaataaattcccaagtgggttacttgaagtgatttaagtgagcctacttgttctttttgttcttggttcctagacccatgtattcttcctactgtgaaggggaggcacagttatacatgttactgattcaatgagcataccacagcatggattgtgttgcatcctcataaagtattgcctccaagcgggatttctagtcttccagttaatgagtggtgttgtatgttaaatgattagttcatctcatggtcagaggtttgccttagcacctcctttgctataaactaggtttcctggttggtcattttttcatgtggaatccagtacctaggattccctaagtcttcagacagtcatactgtttgatgtcctgcaagcaaaaaagacaataagaaaagacaaagatggtcttcttgaagcaggctgctctaatggcaactcagcattggcctttattgatgacagttggatatttgtgtttgcagtagcaaaatcagctaacacaaatagcaagatcaattaagttacttagattccaagagattggacccatgtaaagcttccatccttacttccttggccatttcatgtaatcataatgccagctggagtagctgatgacagagactaatatcaactgggcgagtttttgtcttcttcattgttcagtgcttcttccgtggtgggtgctctctagtgagtattagtgtgcaacaaaaaaacttcgtcatacttcatgctctcttccaggtacccattctaaatgcatctactacagaagttcttatgcagtatcttctcctatctttcttcaggctcctaatcacttagccaagccatttgctactgtccttgaattcacatatgctctgaacttgagttaattttatttttttacacaaaatatatgactacattctgccccctacccccaccacaaaccaagaatctgtacattgcaaggattttctctcactattctttcaatgccctcattgagtggggctataatgcagctgctatctaatttcacattttacccatatgcttaactgacccttttatgaacgaatcatgtgctttgtcttccactatttactgagtgtaaggatcctctttttggtaatgggtgtgagctgggggagaggtgcggtggatgacatgggtggtttggtaatttgcttatacagcttgcatggaccctctgatctgcttgagcttagttctagatgtaacacttagaactctcaataaattgttgcaagaatcttctgatcttagagcttagtgagtttgacagaacccagctcatgacagacaggtgtggctcagttatcacttggtgctccatggtcagctacttcatctatggcaggcccagtagtatgtcaacagttgttgtttaaaaggcatgattctgatggaatgctcttgctccagactaccagcaatctgtgttgtgattttctcattgatacttgccatagtctcgaaatggcatcttttctcatcactcataccactaatgtcataaagtctcccaggtttttatgccatggtacttgcaatgcaccatcccatcatatctctagatggtttatgttatgtcataactctaattatagattttcttgccaaaaagggtagtaggagcatgtgttgtcttgagtaatgtctgaatcatcttcaagcaagaggggaatactaccttttcatagagatgtttcatccacttctgcaaacttgcaagatcaaggagaatctggagactctaaatatgcatggacgtcatccctgatgtctctagcttatttggtcctttgccaaacaggatcctgacttgtaaaagatagggtaagtagataggattggacagagggagaagttgatctgtgatacaatcccagtgaaaaactagggcaatgccatgggatgctctaaagctagacagttctctcggaattgtctaagttacactgagatgacccgattttcactgatgattgatgccattacttgtgggccaccctaggaagaagtgtaaacttaaataatgtggctgtggcagtctgcaggtgaggcaattctggaagaggcaaatgcagaaatctgtttaccaagcactcttatgggatgggcaataagttttcattgaaggcgttgctggcaggacatcagagagtctaccagagtaattataaagcattcagtctaactgtgaaggtggggatataaaaaggagtaagcattatattcatttgtttatctttactttcataaaaggattcatactctactagaaggcaaagatattacaaaaacattaaaacactggtttaacaaggggcaatgcgatagagtgaggaaaacgcagtaaattacttgagcatgaaatttagctctgactcttaacaaaatacagaattacaaaggtttacatggtttttgttagctaataaaaggaatcctgggtttttctttttcctagtaaagtaactctttcctgtctttgaactctgagaagacattattgtgagattcattataaaatgcactgaacaatattctagattgtaacttcaaaagttttgtaacaatggcaaaattgttctacctatgattcttattttgccaagcacctgaagtgtagacattgtgtttatcaaaagaagattcacatgctttaaaaacaaaaataacataatcatattcacggttgacatattgtaagaccatttaaagagtttgtattgtacttgttgaagaagtaatttgcagaatgtaagttaggatattattcttcaccaagattaatcaaaaacatttccttcagcaattactttctgagtcttaaatttcagcaccataagagatactcacatgtgtgtttgtatgtgtgaaaaaggtacacctcagcatagggttgttaattaatttctttaaagttaacttgattcaatttattgttgactaagtgcaattctaggctaaaaatgtgtgattagataggaaagatgtcctgtctaaaagatgtccaaacagactatttgttttcaagaagttatagtcttgtaaggaaagtaagaaagacaaatataaatgctaatagtttcacaataaaaaagtacttatgatggtcaaattaaaaagaaaagatagtaactggggatattattaaatattttaggaagagggaaacatccaaaataggtcttaaaatgtgcctagtatatagcaagccttcaataaatattaccattattactggtgagtttttccttaattgatacctatctgaatactaatggaaaagtttataacattggctgaacactgcgcttttgaaaacttaatcacattttttccttaaggcaacatcaaattgatgaattttgtcttcattttttagaaggaaggaaggagggaaagaagggagggagggagggaggaaagaaaacaaataaacgtctctgaaagagatgaaagtaattttcccgcgccacacaagttagtagacttaagaccagggatctaaatataaggttgtctgtctacagagtccaatctcttttaccacagtcttctattacttctagaaattgttatcaattatgaacaattattccaaattatttactgtgaaaagagtaattgtttcggaatacacaatattgttcttgcagaagagaattgtaggaagaagcctctctccctttgctgcctttcagtcagcctactttactgaaggcttcaaaatgttattttttttcacgtatttagagactgaaaagagttatattatgatttcaatgatttactcagaccacaaataaccatattatgaaaagggcctaaaagaaaaagttatatatccatctataaccactgattcagggcagttctctcacttgcaattgaataatgattgcttcatctctacatgctttacattatttaggattttaaattactaatatgtgaattcctttttatttactaagatggaatgaatgccaaaatttctcttctggaaacttgtgtatcactcaagataagatattgatttttgaactttgtagtacttaaatttttagagctgtggaattttaaagggcttttgcaaaatgaaaacaatgcaaccctgagaagtaggtcataaaacaacaataaacaatacccctacaagatgctgcagttgtgggatgaactggtaataaggaaacaatggagaagggaccaagaaggtagaaagagagacgagggtagtggtcagtacattaaaatgaaaattaaacacctgactgaaaatttgtatcttgtgacatttgtgcttgcacatgctcaacttaaacttatttctgaagatttatacatttatatgaagttgattgatgatattttatgcccatgggagtttggaatcaagcaattcaataactgcataatgctcagtataacaaatataatcctggctatgaaagtcttttttctatgttttctaaaatgaaagtctttcaacggcttctaaaatgaaagtctttctatggcttctaaaatgaaagcacattgcaaaggaaattccattctagcaagtgagattctgttctgatctactgatccataaattatcacagtgacaattatggactcaaataatggtctcaaaagtctttcctagaaccttaataggtttatttaatccctctagaaaaaatggagatttgggaattaaaagccaatagattagctggaaattcataactattaaacgcccaatgtattccatgtttgtgttcttttttcttttacccaaattcaatgtttgctaataaaatagtatgagatttttacttcagtacagaaccacttacgcaatctggccctgtacattagctacttccttctcaactctgtatttactttgcttcttattatattatattatattacttactttgcattaaaaagcagacatggccatcaaccactaattccttttcttagtattgagtttactaagtgaaaccaatatgaagtgaagaaatggcttgacatgtaattactacaaattactatcaactactaaacattactacgaattacctgacaaatggactaatgctgtatttgataataagaatttcaatgagtaattttactttaatttattaattagactgccttttgggtataattgtctcctcttcaggcagtctcagcagaaagttacatggccaaatgaattcggagattcaaatcctgcctcctatttggaggaatgtaagtgagaaaacggagaccatcctatggaggtagtagatttttggttattttctccaagaaagttgttgtaatatttcttttcttaatcttccatgtctttaacaaatctattatttaataaaggcaatggagcatggtagaaagaattggaagtttaagaaccatggtcccagtcataattctttcactataaaatattgcacctacgaaagtataaggcacttttctcctctgtactcatttctccatttgcagagagaagagtgtattattaactcttttttattacgactaaaattaaccctacccaaaataattcaagcataaaaaatgatttatttgctcagaaaaccaaggtacaagaatggccaaaacaagccaaattcaccagaatgctctctctctatctttttctttctcttgctttgagtgtgtgtgtgtgtgtgtgtgtgtgtgtgtgtgtgcactatttctggttgctttttcttagtctatgttaacttcattctcagcaaggaatttaccatatggtaacctttaaaatgcacaggttttcttacaaccaaaaattccagcctaaaagttttccccaaatccctgagacttaggttctgtagccagagagatggagtgtactaatgagttaacacagcatcacctaacaagactaattaaatagtgggctgagagtaggaaacttgaaagtcccttgggaaaacagaagtcctgctatgagataaatgtggagtgaatgctggacacacaaaataacagatgtatattgtaacagggctggaagagatttccattcttccattcactcatttgttctcttaaagaactgtaatacaatattggtcaagactgacatggtctttgtcttcatgcaacatacaataaatggaagagagatatattaaaatgaaaatctataaagctatgtaattatatgtaacatctcttattctatgatgcttagcttggcactcttttcagcatctagtaaactcatttctcacttgcctataacattatttctaatttctcacagatcattggccttatgctaatttgtactactgttttcagactttggagggagtcagttgcctgtagccatctttcatcatacaagattaaggaatacttacagagagtgagttccatacccaaagcatttagtgtggcacaatttggcacaaagtgggagccaaaaacaaattgttactgtcttggtaactacacaactaaattctttctttctcagaaattgatattgtctatattagctatttcatgaaattactgacagagttggttgatatttttcggaatgggtgaataacacattttgcttcttttgtttttctaagaaagacttggagtcttttcttaacattagagattcacccagtgtctttgatacattggtagttatttttgtcattttgtaatgtttgtacttttgagacttttcacgaaggcaaatctgtgtgtttggtgggcaatttgctgctaacctttcctaactaatatgactggattattgtccttttttaatcagtataaatcgccatgaagaatatgtgaatttctaaaggtagaccggaaaatatttttataaaatagcatcatcctcttggtcaaagtaggattatagggacaaacaatcatcttgaaaagttacacagtagaatttgggtaccaatgtttccaatttttggtgagacagtgggagtttagagagggatgaaacatcatgacaacttggctgatacagaacaatcttctagttgatacttggcatataagaattggcacacctatttggaactgagagttaatagaaaagtttttaaaatgcttaaactttatggaaattcttcaaaaaggtatctttaagctaagaccatcaggggttcttcctgcattaagaggattcatagttggcacacagacaactttttgagaatgtgcaataaagacatcacatcttttggtcaaacacatttcaaaaggcatttctccttggttagatgcaactcctgcaagtacatcagtcctacttactgccttgaactgaggcaataaaattttggcttgtagattttaggtcttggtttcaaaatttaattttagcagagagatcttgagctagctacttcatttcacaaacctcactttttctaatctgtaaaatgagataactatacttattttataaatcgtgtacattaaagagtaatgtaggtaaattgtctgtcacatggtctgccaacatccagaccaagcactcaatgaatgaatactagctctgattttattattttgtttgtaataataataataatggtaatagtatagtattattgctttattttaatctctcgggtcatatatcaaatgattgctcataatttttttaaccttacttttacccagttgtcagttccatgactgggtattttaataattcttattgagaagattggaggaatgaagtaagactaaagctataattggttaaaaaaagaaaaaaaaaaagaaaaatccagcaggcattcatattagctagaacaaagaatattttgtcacttctgtgtaatatttatagaatggttttagcttaatccaccatgatcacagagtggacttgtctaaagtcgttttacataaacaattctgtaaattgtttatgtacaacagaagaacagcatagcctttctgtgagcgtgcgggctcctcctggctgagaggttgcttttctctttctcactgtgcagtataccacattgctgcaagctattgtacaacaaaatcatgtccaagggggtgaccaggatagtgaaggatttaaaaacaatattttatgaataatgctttaaagaatttgaattaggattgaggattttagccacagagaagtggatcattgagattgactaactgacaactatttccaaatatgtgaaggttggtcacatatatgaggtatgtctacggttgctactaagttgaatggaagtttttcaaaaataggaaagctatcatttattgttaaactgtaagacatataaagcagaaaaatgagtagttctttttcatgatgggatatgctgtcactggatgtattcataaagagtctggataaactgctggagctattatggtgggacagcaattcattaaattgcattggattacactatatatcttaaattctctggctatagaaacaggtaagatgaaatacaaagatagactcctggatgactaaggctcaaactcagacttttgttttatttcattaaaacagaaaatattccacttctctcaatgtccaatctgttccattctccatctgactttctctgagtagacacagatgagctataatcagggatttgtaattcttctgtaatgacaaatacattaacattctccctgccaatgacaatactgcaaattaatgcttgtccaaatttcattcatttactgaagggcaagttggaaatggtccaaggttttaaaactgccataaccatttgggtaagctgtcaataagctttccaggaactctgagcttgacttaattgagaagagtagttttttgcctgctctgctctttggatgtctgggaatgggtgaccttttgaatcacttcttttttgtttgttttttttttctcactttcaagacttttttttttctatttttattattatactttaagttttagggtacatgtgcacattgtgcaggttagttagatatgtatacatgtgcaatgctggtgcactgcacccactaactcgtcatctagcattaggtatatctcccaatgctatccctccccccaccccccaccccacaacagagcccagagtgtattattccccttcctgtgtccatgtgttctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccacaataaacatacacgtgcatgtgtctttatagcagcatgatttatagtcctttgggtatatacccagtaatgggatggctgggtcaaatggtatttccagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcactgtggttttgatttgcatttctctgatggccagtgatgatgagcattttttcatgtgttttttggctgcataaatgtcttcttttgagaagtgtctgttcatgtccttcacccactttttgatggggttgtttttcccttcttgtaaatttgtttgagttcattgtagattctggatattagccctttgtcagatgagtaggttgtgaaaattttctcctattttgtgggttgcctgttcactctgatggtagtttcttttgctgtacagaagctctttagtttaattagatcccatttgtcaattttgtcttttgttgccattgcttttggtgttttagatgcgaagtccttgcccatgcctatgacctgaatggtaatgcctaggttttcttctagggtttttatggttttaggtctaacgtttaagtctttaatccatcttgaattgatttttgtataaggtataaggaagggatccagtttcagctttctacatatggctagccagttttcccagcaccatttattaaatagggaatcctttccccattgcttgtttttctcaggtttgtcaaagatcagatagctgtagatatgtggcattatttctgagggctctgttctgttccattgatctatatctctgttttgataccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaaggcattggtagcttgatggggatggcattgaatctgtaaattaccttgggcagtatggacattttcacgatattgattcttcctacccatgagcatggaatgttcttccatgtgtttgtatcctcttttatttcattgagcagtggtttgtagttctccttgaagaggtccttcacatgccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaatggggttttctagatatacaatcatgtcgtctgcaaacagggacaattcgacttcctcttttcctaactgaataccatttatttccttctcctgcctaattgccctggccagaacctccaacactatgttgaataggagtggtgagagaaggcatccctgtattgtgccagttttcaaagggaatgcttccagtttttgcccattcagtatgatattggctgtgggtttgtcatagatagctcttattattttgagatacgtcccatcaatacctaatttattgagagtttttagcatgaagggttgttgaattttgtcaaaggccttttctgtatctattgagataatcaggtggtttttgtctttggttctgtttatatgctggattacatttattgatttgcgtatattgaaccagccttgcatcccagggatgaagcccacttgatcatggtggataagctttttgatgtgctgctagatttggtttgccagtattttattgaggatttttgcatcaatgttcatcaaggatattggtctaaaattctctttttttgttgtgtctctgcctggctttggtatcagaatgatgctggcctcataaaatgagttagggaggattccctctttttctattgattggaatagtttcagaaggaatggtaccagttcctccttgtatctctggtagaattcggctgtgagtccatctggtcctggactctttttggttggtaagctattgattattgccacaatttcagatcctgttattggtttattcagagattcagcttcctggtttagtcttgggacagtgtatgtgtcgaggaatttatccatttcttctagattttctagtttatttgcgtagaggtgtttgtagtattctctgatggtagtttgtatttctgtgggatcggtgatgatttcccctttatcattttttattgcatctatttgattcttctctctttttttctttattagtcttgctagtggtctatcaattttgttgatcctttcaaaaaacgagctcctggattcattaattttttcaagggttttccgtgtctctatttccttcagttctgctctgattttagttatttcttgccttctgctagcttttgaatgtgtttgctcttgcttttctagttcttttaattgtgatgtttgaatcacttattgatcagtcatttataagatttttcaggatggcagcaaatggaaatggagaccttaagggaaaaatttgaaagtcatcttttaaattctaaataactttgggatttaaatatctctctttattacaatgtaagttttaaaatgaacattagttcaaatatttggaggatgctgatgagatcctgttgtcagaatgcctatccctggcgttgaataggcagttgacaatggggaactgggaggaactccactgggctggttaatgaaggacttaatgaatctgaccctttttatattgtgctatttgatttggccaccagagcaattgccattttcacttgactgctttcattcctatcttatccatatttgtgtttcttatatttctgatcacagagtcactgagataaaaaatggattttagagaagacattgaaatttactattaaatgacagtccataaagattctttggggtatttttatcatcattcacacttctgagagggtcttgagagtgaccagtcctatacgctggtgacactcataaagccctccctctaaaaggagttcccctacaattgatgccactctcctcattgtaccttgcacagtgatcgtcaaatagtaatagtataacacatataataagtgctagttaaatacattttgggattatctgcataaacaatattttcaccttttgtttttatttacattgctatttgtgagattgtaagactatctaaatagctatatgtaattttccttagacttccctaattttcacttttcctaactaaaatgtaacaatattgcatgaataaaattactatgactacttttctattaataaagtctaaatgttcccatgctatcttgagaagtaaaatgtgtgctgctctgtaaagcagcaaactgggcgtcattgctgggaaacatcaagacacctaaaatcaaactgcttaattctcaccagtcataaaattcaatgacgataaatgttaaattccccaaatcaaggtcaccatgattatccaaacaggtcgctgtggaataataattaatcctgaggacttggtgctagaccactaagattcctatggagtgtgacttcagacttctccttgtgcttccatttctgtaggtataaatatagacaattttaccaacttcacagagtgtctgtggagattaaatgacataacagtgtaaggtatttagaacaatgcctggcacattgtaggtcttcagtatatgttagatagtgataatatatatgaaaagttttaaaatttcaaaaaaatccaaacttttagtcctataactataacgaatcctctttagaacagtggtaaggatgtggtacatgtacaataacaacagcaggacagagctagtaattcaattgtctctggagaatcctagaaacatcatgcatattgctcgtaactaacatatctgtcacagacattgtgactaccataattggattcctcatgtccatttttctgcaggacaaaaagaaagtatagactcaccctattcagaaaacaccactcagcacggaaaatgtgaagagaaaaacagagagacccattgtcagtagaagtcagtgcattgtgactttgacatgagaaagcataaacagtaaccaaaacagcaataagtagagaaaagttattctgggctctaagaagaactgaagtctgaccaacagagggacatatcaattacaagtcaaatgaatctgctttaggacaaaacttaaaggagtaaaattcaagcttttaaggaaattagacttttaacaactgaagctgtttttccccttcagactgaaaataggaagcaagatttagaagcacattttacttgtatatcctctcacgaagtcgattaaatcgaaccttgataggggaaagaagcaaaaagttcaatactagcatcaaacaactgtagagaacagcagagaagcaaatagaaaaagaaaaagaagatatatggtattttagaaggaagaagagggaagttgaagaaagaggtagaagagaagggaagaatgtaagaataaaataaatgaaacaggagatttgggggaaaatcattctcttttagtagcagggagaatgagactaatgatgcaggggaaaatgacagaacatgaaaaaaaaaaacttaaacctaaatgttccacctgtgcaattgtacccaattgatctgtcagtttttaaaagctaagtaaaatgtgttgtgagggatacactggggggtatgcatctgagtcagtggcgattcacaaccacagtgggatatcagtgaattgagctggttggaggtcctatctcttagattagacataaagaatcatggttattaaaagtcccatagtattttggctaacataaagaagttaattttgtacattgggcagattccagcaaagaaattatgtctatgtccacatagggagtatgtgtgtgtgcacatacgggggtgtgtgtgtgtgttttaaataaactttgtgttgcagccatggaaaactatcctcctctccctattttcttaactggtaagggaatttttcttctctttgatgttttagtattgataaaagcagaaaatcacaatacctaaagttgcacttccaaataatattcagaaactctttagagtttaatctttttgaaaagctactaaaacttgaattactgtttccctcttcagggtattttaagaaatcaaacaagtatttttttattatgtaaaaataattctaataaaatttgattctagaatgtttatttaaaatgatgctagaggatgtaaatcatttgttcatattctaaaataagtgatctttagtagataaatataaattttcttaatttggtttctaaatgtttgtcaaaaccaggcacacattcatttattcacaattcaaaatatagtgcagtatgtcaggccttcaaacttaggagataggatcatttaggcacaaattctgccctttagacattcagactatcaagatatttataggagggccgggtgcggtggctcatgcctgtaatcccagcactttgggaggccgaggtgggcagatcacgaggtcaggagatcaagaccatcctcgctaacacagtgaaaccctgtctctactaaaaatacaaaaaattagccgggcgtggtggcgggtgcctgtaatcccagctacttgggaggctgaggcaggagaatggtgtgaacccaggaggcagagcttgcagtgaaccaagatcgtgccactgcactccagcctgggtgacagagtgagactccatctcaaaaaaaaaaacaaacaaacaaaaaaaaaaaacaaaaaaaaaaaaaacaagatattggtaggaataattgctgaacatctgtttttggtaagatggtatatgaaataaacagataaatttctataaaagtacctaaaaatgttttacatagtgtaatgttttcaaatatgtatcagaattcaagtgaatccctcaaagaacacaagtgacaagagacaatatatagtgctaagagaatgctggagtcaagcttacctctagagatatctaccatctgtaagggacttagaggctggattttaacagcccttgggctgatcacagggaaaaaaaggggaggtctggagcttgagcagatccgagagagaactaacaatggaaaattaacaatagttaaagtaacacttaccaatactttgagagcagctaatgtgatttttgaggaaaatttatagccctaagaggtttattggtatttttaaaaaggctaaaagctaatgtgctagtaattgacttaagaaacaacaacaacaaaacacctaaggaaaaggaaaagcaaagaaactataagaaatgaaacagtaaagaacagaaattactgggaacaatataatagggtgtcatcaaaggcagaagttggttccttgctaaaactaataaagatgatgaaccttaggcaagactgagcaagaaaaaaagagaaagcaagagaaaataaatgatattaaggagtaaaaaggagacaaaactcaatatgaaaaaaagttaaaatgagattaatagagccgactttatgtccataaattttcccatttcacctgaaaaactgtaaaacacccaaatgaactcaattattatatctgtgctatatatccattgtcagataaataccttattacatattagatttatttaacctttatttcatctagttctataataaatatatacataataccactagatcttatgttggtgcctttttacttttctgttgtctgaacttcattctagatggattactcaagaagggcttatagaaatcatatttcttgagtttttgactgttaaaaatactttgtgccctttcacttgaatgtcactatttctagttataaaatgttgggctcccattttctttccttgagtatcttaaacatctcaattttcttctaatatgaaatattgctattaaaaatccagtaacaatctattttttcttataatttgttctttttatttatatgcctaaatgagttttatgtaaagtcaactacgtttaataggctatgactcaatgttggttgttgtagtcagtattttcaggtatgcagctatgcattttattatgtaatttctattttacactagcataaaattcacagctttaaccatttttaagttgtacaattcagtggtttttagtacttcacaaggttacaaaaccacaactactttctaatccaagaatatttttatcatcccaaaataaacctgacagccattaagctaccacttctcattccactctcctcttagcccccgcccaccactaatctgctttccacctctatgaatttgattaatctgtacaaatgaaatcatacaatatgtggacttttatgtctgtctttgttttctttagcataatgtttcaaggttcatgcagattgtggcatgtatcagtacttcattcctttatgtggctaagtaattttccattatatgcatatacaatattttatataaccattcattattagatgaacatttgggtcatttccacatttttgttgttataaataatgctgctgtaaatgtttaggtacaagcttttgttttcaattcccattgatatacagcaataattggaatagtgaggatcatcaaattcttccacaacagctgcaccattttgtgttcccaccagaaatatagtagagttgcaattttttcatatccacgtatttttcttgttcttttttctttaaattatggcatcctcatgaatgtgaagttgtatctcgttatggttttaatttgcatttcatcaatgagtaatgatattgagcatcttttcatgctcttattggcgatttatatgtcttcttgagataaatatctactcaatatttttgcccattttagaatttggctttcttatttgttgttggattatgtaagttatttatatattttggatttttgcaaatattatctcccattctatgaattgtcttttcaccttcctaacagtttttttaatgcacaaacattttaaattttgttaaagtctaattatcatatttttcttctttagttgcttgtccttttgggtcatctctaggaagccattgccaaatacaaggtcataaatatttacctcacattttcttcgaagagttttatagtttaagctcttatattgaattgatttttacaagcggcatgaaaaagatgtccaaatttattcttttgtatgtgaatatccagatatcccagcaccatttgttgaaagtgttattatttcccagttgaatcgtgtcttagtccattttgtgatggtatgatgaataccatagattacgtaattcataagaacagaaatttgttatctcacaattctggaggctggaagtctaagatcaaagagctacatgcggcaagagccttctttatgcatcatcccatggtgaaagggcaaagagaaggggagagagagaataaaaggagagagtgaaaatgtcaaaatcttttaataatggctaaataataaaccctatcaataacaaaccctctcttgcaatggcagcattaattcattcactctgtcttcatggcctaatcacctctcattaggccccacctcccaacactattacattagggattacatttccaacacatgctaattggaggacacattcaaaccatagaaaattttcttggggctgggagcggtggctcattcctgttcctggcactttaggagggtaaggctggaaaatcccttgagcccaggagttcacgactagcctgggcaacatggtgaacccagtatctacaaaaaattagtgaagtgtgacagcatgtgcctgttgtctcagctactcaggaggctgaggtgggaggatcacctgagcctgggaggtagaggctgcagtgagccttgattgtgccactgcactccagcctgggtaacagagtaagaactcatctcaaaaaaaaagaaaattttcttggcatgtttgtcaaaaataagttgatcatagatgccaattttctgtattctcctttctattccattgttctctatatctattcttatgataatatcacactgatttgattattgttgatttatagtaagttttggaatccggaagtatgagtccccagctctgttattttttatcaagagagttttgctattctgtgttccttgaagaaattccatatgaattttagcatatgcacgttcgtttctacaaaaaggcagtaaatatgatatagactgcattaaatctgtacatcaatttggggagaatactaatcttaacaatattgtgtattccaattcataccacatgatgtctttcaatttatttaggttttttaaaatctactttcatagtgttttacagtactcagtgtacatatcttgtaacttgttcattagatctatttgtaagtattttaggtttttaatagtatttaaatggatttttcattaatttccttattggaatgctaattgctaatgtatagaaatacaattgactttagtatgctgatcttatatcctgatactttgttacatgtgctaattcactctaacctatttttttctgtacatgcagtctttagggttttctgtgtaaaaatcacatcatctttagatagaaagttttatttcttttttctcaattaaatatattttattttttcttttataatttcatttctagagcttccagtacaatgtaggatagaattggcaagagtcaacctccttgacttgtttttgatctttaggagaaatcttaacccttacccattaagcataatgttaactgctagtttttcataaataccccacaggaagacaagtccctgaataattttgactgacctaagtaggttttctccctcttttatgcataatgtactgagaatgcaaatttctgaaataatgaagaaatgtttgaaacaacttggactatgtccttgtttcctccagaacagaatattctgcaatgcttgagctcaacaatcgaagttgtgtccagggtataaaacacagagctgagtggtttcatgatccttcagatatagtatgactggggacatgaacagaaaaagctccatgtccctgggcagctttcctgagacttaggggacttattcaccagggttccttggcttctgtttatacttggtgcctctcattaatagaggtgctttgcctgccttgttgtgcaagtgttctgtctctcagactcatgcaagtagtaaagatactggggcttcttttgctgctcacaggtgctctcatgaaactgggactgctgtggcaactgggtctgttttttggtccatccacacctaaaaacccttgcagaaattagtgtaaacctttccataccctttactgatttaaggaagttttcttctatgtttagttgattgtgtgcttttttttttttttatcgtaaatgagttttggattttttcaaatcctttttctacattaattgaagtaattgtgtggatttttatggtatattacatacattgacttttctatgttgaaccacctttgcgttcttgaaatacattccactgggttatgatgtataatccttttaacatgatgccaaatataacttgctagcattttgttggaggttattatatctatattcataaggtatattggtcttcaatttccttttctaatgatgtcattgtctgacttagaagtgaagataacactggcttcatgaatgacttgaaaatttttccctccacatatagtttggctgtgtctccacccaaatctcatcttgaattgtaactcccacaattcccatgtgtcatgggaggaacctggtaggaggtgattgaattatgggagagggtctttcctgcactgttctcatgatagtgaatgggtctcatgaggtctgatggttttaaaaaatcagggtttccctgtacaagttctcttctcttatctgctgccatgtgaaatgtgtctttcacctgccaccatgattgtaaggcctacgcagaaacgtggaactgtaaatccatcaaacctctttcttttgtaaactgcccagtcttgggtatgtatttatcagcagcaaggaaacagactaatacagtaaattggtaccagtagagtggggcacttctgaaaagacacccaaaaatgtggtagtgactttggaactgggtaacaggcagagattggaacagtttggagggctcagaagaagacaggaaaatgtgggaaagtttgaaacttcctagagacttgttgaatagctttgacaaaaatgcttacaataatatggacaatgaaattcaggctgaggtggtcaaagagggagatgaggaacttgttgggaactggagcaaaggtgactcttgttatgttttagcaaagagactggcagcattttgcccctggcctagagatttgtggaacttggaacttgaaagagatgatttaggatatctgagagaggatatttctaagcaaaaaagcattcaagatgtgactttggtgctgttaaaggcattcagttttacaaaagaagcagagcataaaagtggaaatttgcagcctgacattgcaatagaaaagaaaatcccattttcaaaggaggaattcaagccagctgcagaaatttgcataagtaacaaagagctgaacgttaacccccaagacaatggggaaaaggtttccagagcatgttagaggtcttagcagcagcccctctcatcacaagactggaggcctaggaggagaaaatggttctgtgggcttgcccataggttactctgcagtgtgcagcctagggacttggtaccctgtgtcccagtcactccagccattgctgaaaggggccaatgtagagcttgggctgtggcctcagaggatgcaagcctcaaactttgacagcttccgcattgtgttgagtctgccagtgcaaagaagtcaagaattgcgatttgggaacctctgcctagatttcagagtatatatggaaatgcctaaatgtctaggcagaagtttgctgcaggggaggggctctcatggagaaactctgctagggcagtgcagaagggaaatgtgaggttggagcccccacacagagtccctactggggcaacacgtagtggaactgcgagaagagggccatatcctccagaacccagaatgatagattcaccaacttcttgcatcgtgtacctggaaaagctgcagacactcaatgccagcccataaaagcagctgagagggaggctgttccctgaaaacccacagggacagagctccacaagaccatgggaacccacctcttgatcagcatgatctggatgagagacatggaatctaaggagatcattttggagctttaagaattgactgccctgctggattatggacttgcatggggccttgtagcccctttgttttggccagtttctcccatttggaacagctatatttacccaatgcttgtacccccattgtatctaggaagtaactaacttgcttctgattttacaggctcataggtggaagggacttgcgttgtctcagaaaagactttagactgtgggcttttgggttaatgctgaaatgagttaagactttggggcacagttgggaagacatgattggttttgaaatgtgagaagatgaggtttggtgggtccaggagcagaatgatatgctttggctgtgtccccacacaaatcccatcttgaattgtaactcccacaattcctatgtgccaggggaggaagtcagtgggaggtgattgaattgagtggggggagggcgggtctttcctgtgctgttcttatgatactaaatgagccttacaagagccaatggttttaaaaaacgggagtttccctgcacaagctttgcctctgccattcacgtaagatgtgacttgctcctccttgcattctgccatgattgtgaggcctccccagccatgtggaactataagtccaattaaacctctttcttttgtaagttgcccagactcaggtatctctttatcagcagcattaaaacagactaatacatctcctattctattttttgcaaaaacttgagaggaagtggtgttaattctttagatctttagtagaatttatcattgaaagcatcttgtcttaggcttttctttgttggaagtttttattattatctttactatttactacatctatttaaatagatcttgtaatcagtactggtcatgtttttctttgtcccttgtaacaaatttgacttaaagtctagtttgcctggtattagtatagccactctggctcagtatagtcactcatggaatatgtttttcatacttcggtttacaaactacttgtgtctttatatttaaagtgaatctctgacaaacagcatatagttggattattttagctcatcttatgaaggtatcttttaattatagagtttaatatatctaaaatgtaattaattataatgaatataattattaataaggaataagttatttttcccattttgttatttgctttctatatcttgtacttttatttttgtctcacaacacatcccttgctgccttctcttatgttagataactattttaagtgttccattttaattcctttcttattacctttactaaatgatttctggttatttcttagtggatcctttggagattacaaaagaaatcctaatttataacaacattattatatcatttgaattaatgtcatatagtgtacactagttactttcttcctgtctcccctttattgatttttatgccacaaattccatttttatttatagtgtgcccattaacatagatttatgatgactgttttgtttaactgtttttttaaaatcaagaaggacaagaaaaagaattacaaaccgaaattatattaatactgaattttatatttacctgtgtagttgccttttgtgtggattgcctttattcttttgtgtggatttcagctacagcctagtgtactttcactttagtttaaaggactccttttagtatttcttataaggcatatctaccagaaacacacttttagtttgtgtgtctgtgggaatatcttacttccttcttcatttgtgaagtcggttttagccaaatacagaattctttgttgattttttttttcctttcagcgctttaaatatgccttcccacagtcttctggctttcatagttttttttttttttttttttttttttttttttttaatgagaattcagctgttaatcttatggtgaatcccttgtatatgatgagtctctgctctcttgctggttttaggtttctttttgggtttattttcagttttgatctttttgcgtttatgcaccttgacattaattaagtttcttgtatatgcagattcaggtatttcaccaaatctgagaaattcagtcattatttctttctttctttttcttttttctttttttcttttttttgagacggagtctcactctgttgcccaggctggagtgcagtggtgcgatcttggcttactgcaacctctgcctcccatgttcgagtgattctcctgcctcagcctcctgagtagctgggattacaggcatgtgccaccacacccagctaatttttgtatttttagtagagacgagatttcaccatattggccaggctagtctcaaactactgacctcaagtgatccacctgcctcagcctcccaaagtgctggaattacaggcgtgagccaccacacctggcctagttctttaaatattccttctgccgctttttttttttttcgtctctcctctcttcctagaactaacattatggatatttttgtatgcttggtatcccacaggtttcttaggctctctatttttctttattatttttcctttatggtcctctgacctgggaatctcatttgatctaccttcaaatcttccctataccttttcaaatcttctgaattcctctggtgaattttttattttagttatatttttctacaccagaatttctatttggtttcttttcaaaatttctatctgtttatgggtattctctgcttggtgagacattgttctgatgacttcctttatttgtttgtctatgattttcttcagccatgttagtatatttaaaatagttgattatacattttagatgagatattaaaaatatacataaaataaaatagttgactaagtcttggtctagtaaattcaatgtccaggctttctcaggaaaaatttttgataatttctatttgtatttttggtatatgggttatatactcttatttcctttcataacttataattattttcttgaagaggggatattttgaatattattatgtaacaactctcaggatcatgttctcctcctccccagaggtttatgttcttcatattgacattgttttgcctgagtgtcaagtggattttctgcactaattttgtaaagtctaaatttcttctttgtgttccttaaaatctccatttcattatattgttggtcagcttgtgatttaatagtgatttccttaaacttgtagaaacaacaacaacaaaacaccaaaaccccagtctttgaagatagtctctgtttctgtgttggagcacatgtttcacattcagacaggaagactgcaattctgcctaatgctttacttctgattgagtagagttcaagtcacagtgagagcttggggccttaacccattttttctgaacatgtatgttgtagcctcagaggttctcagtagtatgtggaagatttttaattcccttattaccagaagcatctaattttctaagctttcctcccaaacttttagctttgtctattgcttaccccaactgttatcccttgccctaggtggcaatgaataatgcatttgtttaaaatatttttttcctggtagccacttcagtactgggagagttcagagttcagtaaaataaagacaagcctagtggtccttcagggagccagcagatgtatcaaaacaaagtcatacttttttgaaaatgagatttattttgctccccctagtgctaggcacctataacctatatcaaaaatgagaattgttgtgctcaaagttgctgcacaggtgggagacgctgcccagagaaattaagactccacaaacgtatactagcaagaatcaagtttcttgtttttcttttcttaattaagcattttcctgattactaaaacctatgatgagtttttccagagttctaataaagttgcttctgacagtgcttaccagtttcttcactttttttatgcaaggacagtcttttgtaattccttattcagccattttcactgatgtcacctcaatttgtttaattattcaggaaagttactaaaattataattggttttatttattgtgttcctttgttttgtatttattcctgaaaacattattacctattttggatttttttactaccttctgtaattattacttatctcaaatccatttttaaagcaatttttcaatttctttttgatttttaaaattttcatccatttgactatttctattaaggctttaatcttttgtatttattggtttttttcattctctctagtttggttttcataaccagaaatatcctttctaattatgtcctgagttgcatagtctcattttgaattttgaataattcttatttaccttctttcatgttttgtaccagagctttaatgtgttttagctattctggaatgatccttggccattcagttttgatgactgattcagcccctttacatctttttaaacacacttgcacttacccacatttccagtaggtaaaactctccaattttagttgctgcacacaactaaaatctacaccattgtggttttaaataaatacctgttggtcatttggatttttttccattctcaagtatttcagattcccacttgctttcttgtgctttctcccctccagacagtgatagtaggctggacttctggctgttgttgtgatttctttttccaattcacttattttggggttcatcaggcacctcttaactaaattttattaacaggttgcccataaattcctgactttcacatttagttgctgagtctgtttttgtctggggatccaaggatattgaaaaactatgacccctgccatcaacttcgcagaatccccattcattcttatttgatgtttatccatatatttcataaacacatcttaactaatattgataaagttaaaaaatagattattggcaggtaaactgatatggattaaccttcatcagtttaccactattaacaccaaagttcatttgcaatattttattttgtacactgtgataagttaattttgatatcacctgtcatttattatagatatgaattatattttaatatgtaaaatatatttcaatatatggaatatagataatatatttatatatatatgaaataacatatgaccccaagattgatgtatatatatgtgtctgtacatagcaagctatttgcttcctctagggggagcaaaacttaaaattatttttaaattttaaaagaaatgtattgattctcattaatacactgatatttttataatttgagaacaacattttctgctttaaatagtagctttttatacaaagttttgaatagcgacatattttaaaatgactagatattcatgcacataaatattcatctggacaaaaaaatttaagactccaaagaaatttttcagctgcttagagagaattttatggcttgacactgtagtttttctgttgccttcttaaattttcccttatagttatataacctactttatggaaaagctgccacagagtcagaaagctactagataatgacagaaaaaattgcatagtttccacttcactaagctcagagatgaaagttaaatattgtttttgtgttctagtcgtgtataaacttactatcacagaacacactctgcccaaatattactatgctattttggcaatagcactggtaatgttctccactgaatagtaaaatatttcagagtctctatgagcttaatatttcaaacctttaaaaactaaaggaaaaagaaataactttaaatagttttgttaatacaacgacatgaacaggttttgtaattttgattaagtgttttagaaaatgtttcatgggagatgactaccttgaatatgagatgactaccttgaatacatatgctctgggtttgatcaggtttttataaaaccttgaaaagcatataactatgttttatcgtagtggattaactgtcaagcaaatcacttgatgtgttttgatgttttatacagaccactatactgtctcttgggcagcaatactaacaacagaaaatatgcagaaacagagatttgttaagaacacatatatgcttcttgaattattcaggttttaaaatgatgctccaagcataccattttcaatactctgcaatgtgttctgttgacatttgctaaaattttgtcatgtatttttttcatctcataaaaataagtgaatattcaacttttccttctttatattatttttgtgagaaatgagatcctttatggtgagactgtgtcactacttgtattatattacactcactgaacacaatttttctcatttaaaaaatgaagattaaaatacatagagttaataaaattgctcaacactatgtcaaaaataagctagattatataaaaaacattagtttcttccatctttcctctacataataaaatatttataaccaatttttgcagtataatcatcctgcactataatctacaatatctcccaaagagcaagtctttgtttctgtgtagacaggcatttgcattttttagacatctgattataatcagtactctatttattcttactatataacattaggtgcttccatagacttgtttactacctttgaagttaatcagagaaggggtaattttgccaatcaagtacctcagtagggtatatcttaattttctgatttgtacatcaaaaattgatctatcaaaaacaagctttaaatttggtaaagaagaagacgttattgttgcagatgctgaaaaactatattaaagaacgtaatcttctgtcctaaaaaagacgcaaatatcgtgactctgtaaatatgtctttcacatgccaggcgcagtggcttacacctataatcctagcattttgggaggccaaggcgagtggatcatttgaggtcaggagtttgagaccagctagaccaacatgaggaaccccacctcaactaaaatttaaaaaaactaatttacttcataaatttaccttttctatacagttgttataaatagatacaacaagacaatatttagtctcttatgtttgacttctttcatgtagcacaacatttctgagttttacccatgacacagcaagggtcagtatttgcttcatttttatcactaaataatactccattctatggatataccacatattgttcatttatcaactgataggcattagattatttccagtttttgtttttcaatattccacttggtagaactctcttagcatacagaatttttacatcttatttctgtctccctttcttccttcctaccttcctgcttcctttccttcctttctatattatagctttccaacacaaattatgaaatcagcaccaataaataagttatagatgttgctaactggatccaaacgggttatccactatttataataagtaaaagtttaggtccttggagtttattataacaaataaagaagggaaattaatgcgacttggaaaaaaatagtaatagaatccagaaagctaagtttattaaagattcatttgcttatgaaaataattcaattaacaattattagccttaaacagattaagctaattttgagagttaaatatctaccacatatagatgaacatttttatgttgacaattttcattctatacaaagcaacacacaatttattattgaacaatgtcaaatttctaaactgcaatatcatataacacctttcacagaaaatgccataaaactaaattgcatcatttcttaagtaaagatagaggaagactaattgctttagaagggctatgaaggccaacatagataatataattggatttctaattaatttaatttgttttacaattaccatagataaattgctattaccacaattcttttttgttgttaaaaatttaaagtgatataatttatctctaataaatgagagataaagtaattgacttttataaaatacattactatctattccccctagagacatatataaaaacaagtgaagttttagatactgttgtacaaatctgcttgggttatgtagaattttagtgaactttcagggaattccagatgaagatcatagaatagtatccttattaggatagacaatactcatgctctttttctaattcagaaagttgatactaatatttataataatcattatggattgaggtaaatttgtttgggtgagagggtgtagcctcaacaggagtctgagcaatgattgtattggtcagaaatgagacctacaggatccctatgcaacactcaatcaattggcagagagagaacaattgctgttaggacatattagttacataactgacgactgctgaacactgtgattttaattcattaaaatcatttaagttccattaattttcttcagagttccacagcatttttaatggtaaacttatagcacttattatagggcttttaagattagatgttcaattttctagtttattataatagataaagatttggcttttctggatattttttgccttttggtcaaaaacgcagatgataaatgtgtcaaatagccatttttggtatcagttgtataaaggccaataatgagatacatcttacaaatgttctttaaaaaacacctctaaatcttacatattctctttgcaattagaaataacattcttatttttgtgtaactcttattacctaaagagagttaaagggtttatgaagaattaaaaagagtgaagaatgaaacattcattgtttcaacaaccctagacatttgaaaatatttcaggagcctaaagctgatgtaattactattagagatctataaaaagaaattacacctgtgtaaaaatctgaatgtcagtaaaatgcctctgagtgcttaaactatttcatttttcaatctacgaaacagagataatatttgccacccacatatctcagaggaatgacatgaagaaagtgttttgtgcttttgtcatatttagccttcattctaatcatcctattaacctgcttcttagtcattacaaagacatccctgacaaagcgacatgtcattgttaaaacacattcctttaactctcatactgtacatctttgctcccaggaagaatttgtgcccaaggatggtgcttgacatttgatttaaagggacttttatttaggtttctactatcaagtatttgagccattttaactattttacttacacatactctgaatcgggcacctaacaataaagcaaattttctttaagaacttaaatacttacagaagaaatttctgtaatgcatctattcagaacttttactttgagctaaaagataaacatcattcaacaaccatagttataatgcataagttatatatactaaatttactattcaggtgttacctaagaagaaatttaagtataataaagaacacttatttttttactcaactacactttatttcctaaaaattaatgtgtattgcaaattaatcttaactttaggtagaaaatggtttagtgctctttcagatgttgatgttaaagataattttgctttaatgcaagataatattactcatttttggtttggcagaaaatactacttgtctcaaaatatccaatttcttttcttctcatatatacaggcagactaaaattctcaagattcctatgcagtcgagttttaccatatgactgagttccaacaaagaaatatgagtagaagattgtataagcatcatttttgacccagggctttaagaagcaggtatgtccactgactattattttttcttttccactgcttatatatcaacacgtctgtaagagatgctaaaaccacagatagtcgactggctacttgaatcagactcaggctgggaaaactcatgttgaatggtaatgtgagtatgaaataaacttctattttgttttagacataatacacctttggtgctaattgtactgcagcttagtccactctaatataacagtgtaataattatttcttttttatttggactttaaaataattgaataatgaatgcaaacttagcattgatattcacttattaatattactgttacttaaataaacacaagacaatgattattactaatgacaatgtagcaaaatctgaatcataaagacagcaaacataaaggcatgcaagcttaaccatcaagttagcaatattcttataatgtgagcagcaggagcatatccatggttctccttattttataaacagaaatcaagtataaagtatgtggttgcttataagtctttgaagggaatgagattttatccagcttcttagaaataagcacatgagcactgacttgattctctgaagctctcatagatgataaaagataaatgtttctcattccaaaactctggaaatttgtattagatcacactccctcttttaattaatatgcaaacacattgcagcacgatgatatatgttttcacatgcaccatctcatttgatagtccataacaactcatatgacacatcagtgtaccctattttgaagaaatacacaatgaaaatcagataattgtatcaataaccttaattcacagcactggaaagcaacagaaaaaaagatttggtgggagatctccttgctttatgctgacaattctttctatattaatattttggctgtagcttggaattataaaccctctggaatagaagaattttgtttccagcatattaagtgtatctcttgaaaaaaacaaataagaaagctaaaatttattttaatgtttttaaacattagtccctggttttataattaataacacatctacaaagatttttattttttatttttaatcaagcaaaaatgggaatcctgggatagaaacaagtaccaaaatgagaatgtttcttgtgataatctacctagactgataacactgagattccattttgacagttgtacaaattgtgggaaataataattcctggagccagtctggaaagagaatagcaggctcccacatgaatctggggccttcaaagtgctactctttctgagaaaatgttagtgaaagaaaagttgaatttcccaaccctagtatatggtaggataaaaaaatctattgagaatttgtaaacataaatagttgtccacaaagttgtgtggcctgaattcattcacactgtttagttataaaacatcaagcagatagctttgtttgaagccatcttgggattgtattgcttctaggctactagcaaagaaaatacaaaccatttctggagaaatgtaagttttcttatataataacttaacagataaagtccaatgaatgtgaattcatagcaaagtaagaaaatgcaatcaattcttattatttgcagtagttatgctccataaagttgctgtgaacactggattagcaaatattgaacaattgctcctaagggaaatgtggggttaggttcctatgagcttgtggtcataatgttttcattaactgataaatacatcattttttattatgtatgtttctgtttaaagacaccttaattaatatatattgctagttcattaacattgaactcatagccgataagatgccttttctccagaaggcacactaaaattttcatttgtttagaagcactaaaaaacacttcagcactacgcttgtgggccattttaaaatgtaaaaaaccatataaatgtgaaaaatatggccctaaatagacagcaaaaaaggtcatttatttatagtaggagatctgaaacaagaggcagaacttcactctgtttgacctcagctgggaatctatcaggtgactcaaaatttttttgctacattgtgaatatacacgaatgaccacagaagtgccatgagtattgattttagggttacaaatatattttagcaagtagataaattcacaattacagaacccatgataaatgaagaccaagtatactgcctagccctgtatgcttgagctaataaaaaaataagcaaacagcagaatcagccatgtaaaaactttttgtgttagaattatctacaaaacatacaataaatacatttaatattctaaaagaaataagaatccttgaatgagcatagattaaggagctgtaaacatgaccaagcagatttcctaaagaaccattgtagaaatgagaaaatatgaagggttttttttctttcttttttattatactttaagttttagggtacatgtgcacaagatgcaggttagttacatatgtatacatgtgccatgctggtgtgctgcacccatcaactcatcatttaacattaggtatatctcctaatgctatccctccctcctccccccaccccacaacaggtcccggtgtgtgatgttccccttcctgtgtccatgtgttctcattgttcaattcccacctatgagtgagaacatgcagtgtttgtttgtttgtttgtttgtttgttttgcgatagtttgctgagaatgatggtttccagcttcatccatgtccctacaaaggacatgaactcatcttttttatggctgcatagtattccatggtgtatatgtgccacattttcttaatccagtctatcattgttggacatttgggttggttccaagtctttgctattgtgaatagtgccacaataaacatacgtgtgcatgtgtctttatagctgcatggcttataatcctttgggtatatactcagtaatgggattgctgggtcaaatcgtatttctagttcaagatccctgaggaatcgccacactgacttccacaatggttcaactagtttacagtcccaccaacagtgtaaaagtgtttctatttctccacgacctctccagcacctgttgtttcctgactttttaatgatcaccattctaactggtgtgagatggtatctcattgtggttttgatttgcatttctctgatggccagtgatgatgagcattttttcatgtgtcttttggctgcataaatgtcttcttttgagaagtgtctgttcatatcctttgcccacttttttgatggggctgtttgttttttcttgtagatttgtttgagttcattgtagattctggatgttagccctttgtcacatgagtagaatgcaaaaattttctcccattctgtaagttgcctgttcactctgatggtagtttttttgctgtgcagaagctctttagtttaattagatcccatttgtcaattttggcttttgttgccattgcttttggtgttttagacatgaagtccttgcccatgcctatgtcctgaatggtattgcttaggttttcttctagggtttttatggttttaggtctaacatttaagtctttaatccatcttgagttaatttttgtgtaaggtgtaaggaagggatccagtttcagctttctacatatggctagccagttttcccagcaccatttgttaaatagggaatcctttctgaactaaaggaggaagtttgaacccaaggcaaagaagttaaaaaccttgaaaataaattagacgaatggctaactagaataatcaatgcagagaagtccttaaaggacctgatggagctgaaaaccaaggcccaagaattacgtgacgaatgcacaagcctcagtagccgatgtgatcaactggaagaaagggtatcagtgatggaaggtgaaatgaatgaaatgaagcaagaagagaagtttagagaaaaaataataaaaagaaatgaacaaagcctccaagaaatatgggactatatgaaaagaccaaaactacgtctgtttggtgtacttgaaagtgacggggagaatggaaccaagttcgaaaacaccctgcaggatattatccaggagaacttccccaatctagcaaggcagggaaacattcagattcaggaaacacagagaatgccacaaagatactcctcaagaagagcaactccaagacacataattgtcagattcaccgaagttgaaatgaaggaaaaaatgctaagggcagccagagagaaaggtcaggttacctacaaaggaaagcccatcagactaacagctgatctcttggcagaaactctacaagccagaagagagtgggggccaatattcaacattcttaaagaaaagaattttcaacccagaatttcatatccagccaaactaagcttcgtaagtgaaggagaaataaaatcctttacagacaagcaaatgctgagacattttgtcaccaccaggcctgccctaaaagagctcctgaaggaagcatgaaacatggaaaggaacaaccagtaccagccactgcaaaaacatgccaaattgtgaagaccttcgaggctaggaagaaactgcatcaactaacgagcaaaataagcagctaacatcataatgacaggatcaaattcacacataacaatattacccttaaatgtaaatgggctaaatgctctaattaaaagacacggactggccaattggataaagagtcaagacccatcagtgtgctgtattcaggaaacccatctcacgtgcagagacacacataggctcaaaataaagggatggaggaagatctaccaagcaaatggaaaacaaaaaaaggcaggggttgcaatcctagtctctgataaaacagactttaaaccaacaaagatcaaaagagacgaagaaggttttttaaaataaaagataaatcaaatggcagagtagtcaaaatttaaaaagagcattaacaaactgaaattgtggtctgaggaaattatccagggttagccagaaaaaaaaaaggaaaaatgtgagagagaggttaaaacacatagcttatagagtgagaaagattaacatttgtctactcaagtttaggataatggaaagagtggaacaaaaacaatatttgaggggataatggctgagatttttttccagggttgttgtaacacattaacctcaatcccagaaaacccaatgtattttcattatagtaaataaaaataaatctatacctagacgcatgacagtgaactgacagacatgaaagataaagagaacctacactgtatacatattatattgataattgatttctttttagcctaatagaataatatcttacatgtgttgaggaaagattactgtcaacattaaaatcatatgcccagtatatctcaaagaatatggacaaaattaagaccttttattaaagtacagaaacttctacttttgagtatctagtaagttacatactcattatcaacaattattaaaaataagcttaaggcagaagaaaaatgatctcagattgaacttataagatgcaaagggaaatagtaagcaataataatgataaacatattggtgagtctaaacaaactgattgcataagactacaataataacattttacataataatcatttaattatgtgtgagtaaaaaattaaaatacctgacaacaatgtcattaaatggaggaagggacagtcagttttcaaaatcctaatgtctttgtaattttataggcactctgtggaaaataaagatataaaatatctttatttagtattgagttaagtatacatggaaaattatctaaggtcaaccctgaataaatataatacagaggatgccttcaaaagtgcaattaaaaaaattcaagagaaggcaacaaagaaaaaataaaaacaaataaaaacaatgacataagcccaaagcccagaatagaatagtagaaatttgtgcagatatatcagttgcaatgatgggcctaagttctccagtgcaaaaggtatttttcagacagtttaaaaaggaaatctgccaatatactatttacattaggtacacttgaaatgtaaggacataaaaatagattttaaaataaaatttggtgtagctatattaattttagaggaagagaacttaaaaatctattactagataagcacgaaactcatttcatagggattatatatttaaacttgaattcatatctaacatgggttgaaaacatatgcaaaattaattataaatgggcaagtctgcctttattcacagagatgttaaaacactatattcagtaactgatagatcagactgacaaaagggtgataggtgtatgagtgttcattttataaccttttcctttactgaaagtcgaagtttaagaggatatttactaaaaaaacgtctctgaaatattgacatatgcagcacatttcattaaaaagctagctacaaacaatgaagatatagtgtctggttgaaactatgttcttctacttggaatactttatcttttcctcttcacctagctaaattatactcatctgagttctcggttgcctcagagaagcctttttgaactcttggacttggtttagtacccaagtacctgctttcattacaccctgtaatactccaataatgaaactcaatgaacttgttgttatttgtttaatgtattttaccctgataaatcaaaaacatgaagccagaagcacatcattctttttctctcttcagttctaacacaatgctaccctcaccatctagtgatagattcttaattgtatatgtaaaggagggaagaaaggaagaaaaggagggatgttattctctattagttttgttgcatgggaaccccagagaatatcctggcattactttgagacctatggggattccagtgtattggaagagtaggagtgttgctggaaatgaggatgcgtaatgctccttcaggaagccaacaccagagagaagaaatgatgcctgccatataatgacaggacttactcaagagccattatgggatgccacttacggacttctataaatcattgggttaagggaggccactttgcagggaccagagtccctgaaataaatacaattatataaaatagtaaaaaataagggttattattgtcccattcatccaaattcttaaactcaggctgatatggcgtaagcaaacatagactacaatataaaacacaacagtgacttataatactcagggcataaggtatgtgccatccagattaccaagatttttttttattcgtaacatgataagagcctttgtatatacagaaactaacttcagaattgactatgtcatgagtagttagaaagtaaggccacaaacaagcaaacaaacaaaaaactgctgaacttaataaaaacacagaaattacagaagacggggagcggcacatctgctccagaaggaattttcaatgaacagcaagaaaaagaaaaaagcttcaccctgaagatttttaagcctggcagagaataaacacaaccattacccaagttcacagctgtaaccttggggagctgaactggaacacagaacagttgccacctgcacagctgaagaaagactaatagcaggaacttaacatcagatcggtgatttcttggctgcagaaaatgtggcatctttcataaagcaagctgttttcctgcttttagtgactccaattctactgaagattgttgttttataatggagaaaaacccttgctggcaacattgcctatatactgatctgtcataaaagactctaacagatgtttgtgcccagtctcccctgtgacagaatattcattgtgggtaatgtttgcagcacattctgcccacgagaagataccagtgatgcatttctcccaaacaacaagcattttgtgcaaatatccagcacatctctgaagattgttaatccaccacctttcattaagtaaaattcacattcaacagtttacagaataagggagaaaatgggaaaataaattgtaaattccttttccttggcaagcaaccagattgcagtattgcaattagaattttccccaatattaatttgtttttttttgagaaaaccgatagttgtcttgtagaactttccatattctattctcaaaaaattatttcctcatgattcagttatgattatacatttttggcaagaaactattggtgaactgtcttttattgcattgtgtcatgagaaatgtgacatcaggttaccccactattgttgatgtcacctttaatcacttaaaatggtgagtgcgagatttacgtatctcttcattgtaaagatacatttttctttggaataagtaggtgagaggaaggtgccatgaaaggcacagtttaaacaattgaatatagtggttgagattgaggcagagagacaaattgggcaattgttatagtaatccatgcaagaaattatcagagactaaaagagtggtggcaaggtagaattgggtagagagaaagaattccagaaatgttaaagtggctgaatcaacaggaactgtagagtgactagatatacgagataaggcaagatttaaagaatgtggaaaggagtgtaagctaagtactaggtttggggttgcaagatgaaaatagcggatttctttttggatcttctgagtataagattctctgaggaatttcaaatgtaaatatcagttaggtatctgaaagtaaaggcgactaaaatttaagagaggttactgtacacactgtatatttgcttaatttccttttctatctttcctgatggattccatttcatgttgatgggtgataatatttgaataacaatgcataaaagtgatatagtctgtgtttgcagctcatgtttatatgtattcagaaagtttacattaaatgactatgaagagatctcaccaatttcctttgacaacccattgaaccagctctatttattataaaattcccattataacggaaatagactttcagtacctgacacttcttttaaacttttattttaagttcacggttacatggacaggtttgttacataggtaaacttgtgtcttgggggttagttgtacaagttattgtatcacccagttattaagcctagtacccatagttatttttcctcatcctctccctcctcccaatctccactctctgctgggccccagtgtgtgttattctcctcctttgtgtccatgtattctcattatttagctcccacatatgagaacatgcagtatttggtttttttttcctgtgatagtttgctaaggataatggcctccagctccatctacgttcctacaaagggcgtgatctcattctctttatggttgcatagtattccatggtgtatatataccacattttctttatacagtcgatcactaatgagtgtttaggttgattccatgcctttgctttcgtgaatagtgcagaaatgaacatatgcatttatattacctgacactttaaatgtttgcttgtgtttctaccacttcattgtcttcttagataaatctatgcatatatgtttatcacattttacacaaatagaagaatgtgctgtccttactgatatctgtattccaagaatcaacaacaaatggacattttatccattgtcttacatctcttattctgtggatgtttcacacagttaattctaacacaatgggaaaacttccaaaatatatgattcatttaatttaaacaaagcttggaaaacacaactgaggaaagaggtttgttttctgatgatagaggtagttcaaagaaggtgttaattattgtaaattttgggacttaaattgcaacctaatccattggttattgaaactcagaacttgagtactcagtaacttgaaatggaatagaggtccttatgtcttatttgtaaaattttcatctcaatcattttattctagtgtcccatggtttaatattcatcttatgtcagaattaagtgttctgtgatgttcaacaaatttgtaatctcactgaaggtataaatccggaattttactgtttctagaaacagtttaatcacactgtatatgttgaagaagtttggagtaacatattggccacttaacattatcttatttaatagtcattacaattttttgagataagcagtgtaatcctatatcaaagacaaataaattgagacttaggaggtctcaataatttacataattccatataaccaatcagtaaaaaacaaacaaaacaaaagaaaacaaacttggtaggtctgcctcactccaaacgctggactcttccagttctaccaattgtcttcagtatgctgtgccttaagaaatttacttaactgtatcaaatggtcctatgatatgtgcttggacacatatccaatagccaactctcctcagaaatctccaagacagtcctacttgcagggtaatgtcacattcagcccctcactaatagttagtctattcgtcttgtgctttatcattaatgttcctctgatttttacattctgcattaggctaagcatcaaaataatatgcacagttttttaaaaaaaaatagatgttcctttctcactcctaactattctatatcagtaagatatttttcttatactaaaacatatcacacttgttttaatgtaaggataatgtcttgaagtattcagtaataaaattacttaatttcccaaatttgagccatgttttcctaaatttgggcaatatttatgcttcaggaagatataccctgtttggttcattatttggattgtaacttcctctttgtagttttcatctgtgaaatctccagttgcagggactgtgcatacttctggtaatccccaatgtctggtgctaccgtgaagcctatgagcttccagtatcagatgagtcagaggtagattaagactgaaaggtagagggtcttaaaaccaatagactaagagcatggatttgatcatttatccccaagtttaagcaactatcttcagtagttggcttacgctagagtcaatggatataatgtataacatatttggagttatttattagtatttatacaaccctataagaagtaggaaagaatgaaaaggaaaagaagaccatatctatgaataatttattgatgatctgaacagaagttgacaaaaactccactgtcaggtgggaagaggtttgttaggaaattcagagaaatgcaggggcctagttaagatgcttgtgaaggtatacttttttttggcaaatacatgatttataaatgtcagtttcactctatattatcaagaacataattaatatttttatttttttaattttattattattatactttaagttttagggtacatgtgcacaatgtgcaggttagttacatatgtatacatgtgccatgctggtgtgctgcacccattaacttatcatttagcattaggtatatctcctaatgctatccctcccccctccccccaccccacaacagtccccagagtgtgatgttccccttcctgtgtccatgtgttctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacctgtggatgtgtctttatagcagcatgatttatagtcctttgggtatatacccagtaatgggatggctgggtcaaatggtatttctagttctagatccctgaggaatcaccacactgacttccacaatggttcaactagtttacagtcccaccaacagtgtaaaagtgttcctatttctccacatcctctccagcacctgttgtttcctgactctttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtcctttgcccactttttgatggggttgtttgtttttttcttgtagatttgtttgagtacattgtagattctggatattaggcctttgtcagatgagtaggttgtgaaaattttctcccattttgtaggttgcctgttcactctgatggtagtttcttttgctgtgcagaagctctttagtttaattagatcccatttgtcaattgtggctgttgttgccattgcttttggtgttttagacatgaagtccttgcccatgcctatgtcctgaatggtaatgcctaggttttcttctagggtttttatggttttaggtctaacgtttaagtctttaatccatcttgaattaatttttgtataaggtgtaaggaagggatccagtttcagctttctacatatggctagccagttttcccagcaccatttattaaatagggaatcctttccccattgcttgattttctcaggtttgtcaaagatcagatagttgtagatatgtggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgtgggctcttttttggttccatatgaactttaaagtagttttttccaattctgtgaagaaagtcattggtagcttgatggggatggcatttaatctatactttaccttgggcagtatggccattttcacgatattgattcttcctatccaatgagcacagaatgttcttccatttgtttgtatcctcttttatttcattgagcagtggtttgtagttctccttgaagaggtccttcacgtcccttgtaagttggattcctaggtattttattctctttcaagcaattgtgaatgggagttcactcatgatttggctcactgtttgtctgttattggtgtataagaatgcttgtgatttttgtacattgattttgtatcctgagactttgctgaagttgcttatcagcttaaggagatttggggctgagatgatggggttttctagatagacaatcatgtcatctgcaaacagggacaatttgacttcctcttttcctaattgaataccctttatttccttctcctgcctaattgccctggccagaacttccaacactatgttgaataggagtggtgagagagcatccctgtcttgtgccagttttcaaagggaatgcttccagtttttgcccattaagtatgatattggctgtgggtttgtcatagatagctcttattattttgagatatgtcccatcaatacctaatttattgagagtttttagcatgaaggagtgttgaattttgtcaaaggccttttctgcatctattgagataatcatgtggtttttgtctttggttctgtttaatatgctggattacatttattgatttgcgtatattgaaccagccttgcatcccagggatgaagcccaattgatcatggtggataagctttttgatgtactgctggatttggtttgccagtattttattgaggatttttgcatcaatgttcctcaaggatattgatctaaaattctctttttttgttgtgtctctgcccggctttggtatcagggtgatgctggcctcatgagttagggaggattccctctttttctattgattggaatagtttcagaaggaatggtaccagttcctccttgtatctctggtagaattcggctgtgaatccttctggtcctggactctttttggttggtaatctattgattattgccacaatttcagagcctgttattggtctcctcagagattcaacttcttcctggtttagttttgggagggtgtatgtgtcgaggaatttattctagtttatttgcatagaggtgtttgtagtattctctgatggtaatttgtatttctgtaggctcggtggtgatatcccctttatcattttttattgcgtctatttgattcttctctcttttcttctttattagtcttgctagcggtctatcaattttgttgatcctttcaaaaaaccagctcctgtattcattagttttttgaagggttttttttttttttttgtctctatttccctcggttctgctctgattttagttatttcttgccttctgctagcttttgaatatgtttgctcttgcttttctagttcttttaattgtgatgttagggtgtcaattctggatctttcctgctttctcttgtgggcatttagtgctataaatttccctctacacactgctttgaatgtgtcccagagattctggtatgttgtatctttgttctcgttggtttcaaagaacatctttatttctgccttcatttcgttatgtacccagtagtcattcaggagcaggttgttcagtttccatgtagttgagcggttttgtgtgagtttcttaatcctgagttctagtttgattgcactatggtctgagagacagtttgttataatatctgatcttttacatttgctgaggtagagctttacttccaagtatgtggtcaattttggaataggtgtggtgtggtgctgaaaaaaatgtatattctgttgatctggggtggagagttctgtagatatctattaggtccacttggtgcagagctgagttcaattcctgggtatccttgttaactttctgtctcgttgatctgtctaatgttgacagtgggtgttaaagtctcccattatgattgtgtggcagtctaagtctctttataggtcactcaggacttgctttatgaatctgggtgctcctgtattgggtgcatatgtatttaggatagttagctcttcttgttgaattgatccctttaccattatgtaatggccttctttgtctcttttcatctttgttgctttaaagtctgttgtatgagagactaggattgcaaccccttcctttttttgttttccatttgcttggtagatcttcctccatccttttattttgagcctatgtgtgtgtctgcacgtgagatgggtttcctgaatatagcacactgatgggtcttgactctttatccaatttgccagtctgtgtcttttaattggagcatttagtccatttacatttaaagttaatattgttatgtgtgaatttgatcctgtcattatgatgttagctggttattttgctcgttagttgatggagtttcttcctagccttgatggtctttacaatttggcatgattttgcagtggctggtaccaattgttcctttccatgtttagtgcttccttcaggagctcttttagggcaggcctggtggtgacaaaatccctgagtatttgcttgtctgtaaaggattttatttctccttcgcttatgaagcttagtttggctggatatgaaattctgggttgaaaattcctttctttaagaatgttgtatattggcccccactctcttctggcttgtagcgtttctgccaagagatccgctgttagtgtgatgggcttccctttgtgggtaacctgacctttctctctggctgcccttaacgttttttccttcatttcaactttggtgaatctgaccaaattatgtgtcttggagttgctcttctcgaggagtatctttgtggtgttctctctatttcctgaatctgaatgttggcctgccttgctagattggggaagttctcctggatatcctgcagagtgttttccaacttggttccattctccccgtcactttcaggtacaccaatcagatgtagatttggtcttttcacatagtcccatatttcttggaggctttgttcgtttcttttattcttttttctctaaactccccttcttgcttcatttcattcattcattcatttcatcttccatcactgataccctttcttccagttgattgcatcggctcccgaggcttctgcatattaatattcattcaagtcacaccctgtatctctgtgtcttagttaagttagaaaagtaactttttcgtcacatgatccagaataatttcagtttatagatattagtagctaataaattgtattctcattgtaaaataataatatataaggggcatgcaggagaaaaagtaaaagaagaataaggaagccaaggtaagagtttgttaagtaaattctcatcattttggtttggaatgtaaatataaatgcttcaaaatctgacagctaccctcagctctatgattagtcgctctgttttcctgctaagtcagcagatgcttgtgtctcaaacatgaggttcctacttgtaagaaatgccagaaaagacagaacactaggtcatccattttccctagctaaacaaagctttcattttgcttgttcccagaatgaggcaaactgggaagaaactatggaataatggattggatttatgggcatacattagaggtctataaatcattataaatcacttgtctcttcataaagccaatatgttatatagaaatgagctatggacaagggttatatagggaaatctttcacattactcgcagtaagaaagtcaagcagttgatctttcacaatggcatgtaattctggctgaaagaaatgagggcctattttttgcctcaatattttcttgcaaaacagggatatattattccaatttgttgcagtaggcaaaattaaattggtaagagttatttcttggactctgtttctattttatctgctactgaatcatttaattcattattttatacttaatcagattttagctcctagattattgggctttaaacttttaagagttcttattttttctccttattaaaaaccttggcatgttaccagcacactacataaaagagggccatagcagcgctctccctggaaaattttatttgaagcaagtggtaggcataataaaatgttcccacaagcttagaaaagtttaaacaatacacagaacaagtttattgtgagtttgcttcctgggttcaagttatggtaccctccaactataggcattctctccacctttacatcattcataaatttcatgagaaaaatgatacttcagtgactattgctcagttaccatacaaatagagaagatagatgttttttcttcccatctgccattatggaattagttaatgaatgctgtaacaccatagcatttagcaaatttgaaggatcttttttttcatgtttactacagttccttgttttattctccaggtagaatctactcagttacaactcttaatcttattcaatattgacaaccagatttctggctggctgttatactcaatgatgctgcccctcccatttttattacaatggaaagcctgtagctaggtgatagaggcggttgcctgtgaaatgtaacccaatacagtacattttagtttgttagatgttctgctttggtcttctgacagttgttctggaagtaaataacatctgccatacaattggctggcaaaactcatttgtagtataattaaacagccatcattttgttagagcataaacacaaagataaatagtccatgaattagcaagtgcaacatcatttgacagctcacagctagacaggcataatatagattttacctatatgcagagtgtccttgcaagacagctaacaaaatcaaaagcaaaatcagtatctagaattttcaaactggaggtgggagtgtttggacagccttagcaatcttacttttgccatattttgggccttttctttgatcttgcatggtggccggtccaggtggtcttcttcacctttaagttatattttaaaggttttccatctttggcattttcttttctagaattgtcaccaccatttcttcattagagctagaacagaaaccagaagtcaacccaacttaagtattagccataggtatttatcttcctcccaggtgtctggtaaagtagtttaatttatgtaaaaaggtcagaaatgaagaaaaaacttgtagaaatttatactttatttttgtgctctctccaaaatggctgagaggattgcctctgaataacaggtaatttaatgaagcatttcaattcacagtcaattctgttttataaagaactgattgtacagtggagtagtgctatcctttgctgctgtcccttcctcccttggctctttgcctttggactggtttgctggacattaggagtgttgcttttagaagggcaaaggaataaaatggatacaatcttcagagtatggttaggaaggaccagtgaagccagttgtcagtgaattttgtatccatattgtctctatacatgattactgagctcctttaaatgtagatacacgaatctttatatcactctttcttaaatgagaagaggaactattttattcttagaatagaatatagtcagtagtcaataaaatatatgttgaataaagtaataaataagttaaataatttatttcaatttgcttgaaataccactactgcattgaagatgagacctatgaaatttaatgactgttagcaattaaaactattttatttccattgttatgctttccatcttgtgtatagctactgttgataattactgagtgagctcctctgctgaatgcattatataaatactccattaatttctgcaaacatttattgttttaattttatgataaaaatgttatattctcaatttccatgattagtattgatcagattgagctgctctatgctgcagtaaccaataaccttaaagattcagtggcttcataaaattaagtttattttctgtttatgatcaacttatattgtaagacattagagggtttggtccacatagactttgggaaagtgagctgagaatgacaacaccaccttggcactatatcatctggagcatgaaaaccccataaccacagtttgcaggggaggagtgagtgagctggagtgtcatgcaccagctcttttatgctttggcttcaaaatggtccaggtgacttccactcacagcccattgaccaaaaacctgccaaacagccctgactaatttcaggggtggggaaggtggtgagggaacagatggaatctgatgagcaccactgcccctgataagcaaagttatgtgccctctggaaccagattagaaaacacagttgacattgcttaacaaaaattgaaattcgaaatccagaaattcacattacagtagaacttgaaacacattgaaagacactacagaagaaaaattaacatacattatcacaaagtagaatttatcaagagcaggaagattgagtcaacatttgaaactgatcaatataatccaccaaagaatagaataacacagaacaatcatatggccataataataaatctataaaaagcttttgataaaatgttaacagtaccttcatgattaaaaattgtttgttagcaaacaaccccatcaaaaagtaggcgaaggatatgaacagacacctctcaaaagaagacatttatgtggccaaaaaacatatagaaaaaaagctcatcagcagtggtcattagagaaacgcaaatcaaaaccacagtgagataccatttctcaccagttagaatggtgatcattaaaaagtcaggaaacaacagatgtggagaggatgtggagaaataggaatgcttttacactgttggtgggagtgtaaattagttcagccattgtggaagacagtgtgacaattcctcaaggatctagaagcagaaataccatttgacccagcaatcccgttactgagtatatacccaaaggattataaatcattctactataaaggcacatgcacacgtatgcgtgccacaataatgtggccctgttcacaatagcaaagacttggaaccaacccaaatgcccatcaatgacagactgaataaagaaaatgtggcgcatgtacaccatggaatactatgtagccataagaaggttgagttcatgtccttttcagggacatggatacagctggaaaccatcattctcagaaaactaacacaggaacagaaatccaaacaccacatgttctcactcataagtgggagttgaacaatgggaacacaaggacacagggaggggaacatcacacaccagggcctgtcaggggttggggggctaggggagggatagcattaagagaaatacctaatgtagagaacgggttgatgggtgcagcaaaccaccatggcacgtgtataccaatgtaaaaaacctgcacgttctgcacatgtatcccagaacttagagtataagaaactttttttttaattgttagcaaactaaaactagaaggcaacttcctcaatttgatgaagggcatctacaaaaataaatagctgatgtcacatttaatattgaaatattaaattctttaacccaagattggaaaaaagataaattgccctcttttactacttacatttaacactgtgctataataagggtcatgctcagcagatgaaggcaataaaaaattacaaaagaaatacaatttggaaaataaaggcaaaaatgtttccatttacagacaatatgattatgtgaaaaattctagatgctaaaaactcctaaaacataaatttggtaaggtcccaagatacaaaatcaatgtacaaaagccatttgcattcctgcatactagcaaaaaatagttggaacataaaatcttaaaaatatgccatcaagaacataaaatactgtacttagtcataaaatttaaaatatctacaaaatctatacaatgaacactacaaaaaattgttaagtgcaattaaagatctaacaatgagatataccaaggtcataaattagaagacttgattttgtgaagatttgtctatcattgaatttacctgcagactcaaggcaatttgacttgaaatcctaacattattttgaaaattgtttctaaaatgtatagaaattaaaaaaacctagaatagccaaaacagacttgaataacagaacaaagttgcattactttaactgcctaaattttaagtctaaagtaacaatacatgatatgcttatgaatagacaaatagatcaatagaacagaacagagattctgtacagaggcaagaaaccaaggtaattcaatggaggaaggagaacagtttcaataactggcgttggaataactggtatccaaatataaaggccaaaaccttatttctaaaacaaaacctaagaatactttcatgaatttggagtaggtaaagacattttagaaagaatacaaaaaatatcatagaaaagtgataatatggattccactcaaaataaacacttccattcatcaaacattttgttaaaacaatgaaaaggcaagacacaagtttgaagaaatatttgcaatgtgtattttgaaggatttgtaatcaatatatgaaatttacttttctgtatcaatgataatcccaaatgaatttacaagaaattttgtggccgggcgcggtggctcacacctgtaatcccagcactttgggaggccgaggcgggcggatcacgaggtcaggagatcgagaccatcctggctaacacggtgaaaccctgtctctactaaaaatacaaaaaattagccaggcgtggtagcgggcacctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaagaaaaagaaattttgtaaaggaaggtatacaaatcccagtaagttcataaataagaaaatgcaattattccccactacaagatactttattccccactacaagatactttctcacaccaactacagtgtctcaaattcaaaagactgacaaccataaattatgatgatggtgtataacaacggggaccatactataatggtggtggtaatataaaatagaccaaccactctggacaattctttatccgtttctcaagataaacatacatgtagactgtgagccagaaatttcacattttgacatttatctgggaaaaaaggaatacatatggtgcacaaaaagaattgtacaaaaatgtttatcacaacttgtatcaatagtccattagttattgctgagtagattttctccttaatgaacttttgattgttgaattgcaaaaatattattttgagtgaatgaagccagacagaatagagtacactccctatgattccattcatgtgaagttcaaaagaaagtaaaacatatatattgattgaaatcagtacagtggttgcctgtctgtcatattttgactgggattaactatcagagtgaatacattctttaaagcttattgaattgaactcttaagatctatgtgtttcagtgtatataaattttacctgaataaagagactaacacaggaaatgtttataactatacctatataggtatacatatctcaaatactgtttgagtttatttttctttttcttttaagcaaaatgtaatagagtaaatagttcgctggcaaacagaaaaacaaaagcagcaaacaaacaaaacccaaaaacctctctggatattttgtgagattaatgacaagaacaataaactattaaaacaacaataacacatgacatgaaggttaaaagtaatattacatcacaatctactggtgcagctgtcaacatgagaaccatttcttacgtatagaatcatttgtgtatatatttctgaaacacttcgtgagaaattgaatgattaagattttagaactggtgagaggaaaaaaagctatggcctaaaagctatatataatttctggtttagggcttcaattaaaacaaaacaaaacaaaacaaaaacatgtggagtgctattcctcaacatggctgtagaaaaatttaactcaagcaagtgcagtgagtgagatcaggcaaaactgcagtaaatacacactcaccataactataacttagtccaaaaggaatgaacaatcttctatacaaggtaaatgaggtgaaatgagaaagttgatgacctgtgttttatcatatatatatgatatatatatatatcattcatatatatatatgaatgataaataatgcattcattatatcatctacattaaatgtgctttagaaacaaatatatataggataaataatgcattcattatatcatctacattacatatgctttagaaacaaaaatttacttgatattttgacaaacccacccttcattccttaggttaatttctgtgttaatttttacattgctaatcattgtactgctgtagctaaatcatctgaatatcagtttatgcagtgttgctcaaaagatgtataaatagccagctctatgattacctaaaaacaagctttttaaaataaaggaagaaagcaacaatgttccaaatgaatggcacagggcaaaacacatatatcaaaacatatttagacagtattcggtgcccatcagtttctcttataaagataaatgcttgaggaagatcttgagagaaccctccctccctctaaatgtttagctcctacatggtgtcagatgttacaattgatatgaaggataaatgctttcaggcaaaagtaaaaatctatctacaaagcaatatagcaaaatctgtagtgacttttgtagaaagctcccttctctgatggtaatattctttagtatatatccaggatagattaaattgaaacaatatttctgatacaatagcaatactttcatatactgttactaaatattacaaaattccaaaaaatacataaatatcccttgtaccatgcattatgcaccagtttggggctgcctgataaagtcatggctagtattttaacaattaaacattacaactcaaaaattctgccatctatacacagtgaatggacacaatggtgagggctcctgagagatggcaagctacctctaaagtgaaaagtctgtggtggagtgtctccaaattaaagagaggggaacataactttcaacagtgaagtcaaaacagatgtaaataagattgaggaatttcttgaagaagtcttaagccctcccacgtacttaaagccttcaccaaaacacccagaatcaaatactgctggaatggacatctttgccaaattctctgcatatatcaagaattcaaggccagaggctaatgaagcactggagaggggtctcctgaaaaccctgcagaaactggatgaatatctgaattctcctctccctgatgaaattgatgaaaatagtatggaggacgttaagttttctaaacgtaaatttctggacagcaatgaaatgacattagctgattgcaatctgctgtcaaagctgcatattgtcaaggttgtggccaaaaaaatcgcaactttgatattccaaaagaaatgactgtcatctggagatacctaactaactaatgcatacagtagggatgagttcaccagtacctgtcccagtgatgaggaggttgaaatagcatatagtgatgtagccaaaagactcaccaagtaaaatcgcgtttctgaaagagatgtgttcatgtcttgctctaagaatttgcttttcctaacaggctactcctcttcctgtagagtagaaattgtattttgcatgaacatgcaattattgaagattaggatcaagcatagacaaggtatagtagttatcttaagatatacactcctaagcagtattattttaaaatcattttatccctctaaatgttcgaggaaggcatgtctattgtgattttaatgaagacagaattatttttctctgtagaaagacaaatactactttatcagggaagttagtcaaatgaaatggaaattggtaaatggtcaaaagctagctaggaaaaagatccaacaacatgctttaaccccattgcatgtttgtggaaagaccatagcttaaaatcttgagaaatttgggacataaaagttttcatggtagacagttcatggagtatatgaactgacattatggaaaaatctgattttatttttacagttaacaaatccattcctcttaatttaaacacctgttgtgttttacttcgatgaagagattggagtctgaatagaaagtctgttttccgggggatactgagaaatttttgtattcaggagttggaaagctctcttccattctagttgataaaacttccctttttttgatgtagatgcagattttctatacagttctgttgtcttcttttactaggactgttaacttttgtgataaaattcaaataagattttatttcttgataattttggttttcacaatttatctttaaatccttgagcaatctgtatacaattaagagatttctcacatttattcttaaactgagtagatcaactctaggatttaggcatgttaactttacttctgttgtgttttgaatctctccagagttgcatgtaggtagcttttatttctgtgcgcttacagtcaattagaaaatatctacaaagtaggctgggtgtggtggctcatgcctgtaattccaacactttgggaggctgaggcaggcagatcacgaggtcaggagatcgagaccatcttggccaatatggtgaaaccctgtctgtactaaaaagacaaaaattagctgggcgtggtggcgtgcacctgtagtcccagctactcaggaggctgaggcaggagaatcacttgaacctgggaggcagaggctgcagtgagacaagatcatgccatggcactacagcctgggtgagagagtgagaccctgtctcaaaaaaaaaaaaaaaaaaaaaaaaagaaaatatccggaaagtgaaaatggagaggaaatagaaatgtatttttaatgaacattttgatacaaatttcatcatttaatgattcaccaatttcttacattaatttgaattaagcattgaattcaaagagacaggagcattcattgatatatatggacttttaaaaattccatcctttataaatagacaaggtttgggctacaaaaattatatttttatcatggaaaaatttcaactcctcaagtcataatgttgaatagaattggagtattttctttagaatttcttgaacaggcaaattaaagcttattatagaatgcaagtatttacttttctctttggaatatcaaaaccagtgtattgctgacagctattgtattttaaaaaaatgtatattttcactatcataaaggattctttttcctccctcatgaaaataaatgacaactgggggtaaatatatatatatataatttctgaagtaaaaagaaagatcctcccttccaaacaaatatgatcatattttattctacttgtgataaaggcagtgaggcatttgttttggggaatgtccaaaatatctatgattttacttttccagccaaaacaattttgcttctctggcacgtattaatcaataggcaaaacattttgaacttttaaatattattccacatcacactaatttattctagttcagaaaaatttggagtgccagtatttctagcacaatcatatttttaatgggtgaacataaagtatttttcataagaacataagatagcagaaaatatatatttgttgaagaaatagaaataaataatataaagttgccaacaaacagaaaaccaaatgacataagtactaggaacttctgactagtatagaagtaatttaatatttatatttggacatacactggctagactaattattgataaagtagtcattgcccatctgcaaaatcaaacaaccataaagtaacattttgaattgtctgccatggggctcaaagtcttttatgtatcaacctttgatttaacacattagagtattaccatagtataatgaaaaatctaaaagcttttgaatcagataactttataacacagtacgtttgtcttttggtgtctgtgtcatcttgaaatttatatatatttctgaatcttagttttctcatgtttataacaactggggataataaatttacctcatttcaaaacatttacctttagtataaaaataaaaataaattatcaatataaaaataccatgcttgatacttaggctctaaaatattagacaaatttcctggcatcatagcgcttacaagtagttgagataaaggtggagaacaaacacaggaactaactcattagctagctcttaccttgaaaattaagtgcagaactctgggagaatgatgcattcaacaaacaatttttgaaattgcgaaaaaggagaatgggcagaattaaaatgctcagtagagacagtcaggaagggcaggccagggtaccagttcattgcagtaagtggttgttaaacacggaggtaatacacagcaacagaaaatagtaaaatgggccaaaactagaagagtagaggttgaggcaagaaaaactagacttcttttacaattttgcctagggttgacaatgtactttgggtttcaaaacaaataatttctgtctatactactatacagatgtaaatgaaatacatgtttactaagccagtggtatagattgttcagcattgacctagtttataattttgaaactagataaggtttttataaacatgcaaaaactgagtgctacttagttctgctttctggctttttgataatccaaggaagcagactcattaagattgaagtatccaggaagatatattttccaaaggataaaacctacttagatggagagtagattttaggctatcacttaatttcttcctgttaatttttggctgataattttattttaaagagtaaattttactacttaaattatttgtactctacacaaagatggaccataaaacacaatgcctcatttaggcagacttcgccataccagcagcattgtaactcaatccatccatttgtaaagctgtaaccactgctgacagaatgcagggtgggagagaggaagaaaattaaagagtattcagatggtagaataatactaacataagtagttacagtaattacaaatcattcaaccaaccactaatgctattagatggcatgatttattgaatatttacatatgtcgaacattgtgctcagttcttcatatttatgccacacaattttcaccatatttctgtaagataagcatcatttccattttgccccttctgcagttaatgctcagatagcataaacaaaatacccaaatctacacatatggagtttgaattcagttttttctaactccaagttgaatattcaaaagcatcctttgattttataatttaagatttctcctttttcaaacaccatttggtgagatagaaagcattagagataaaacacatatattaatctatgtggtggctctttcttctgcttaaagccattctctataatcctcataaagatctaacacccccactccagtatttcctatgtttctttagttctccattatttcctatttgtgcagtatcccacatgctcagggtgttataaaaggctgcaaattaatgaacatgtgctgcctttgttcggggattttatattataaatttgtttttatttattctacacatggttggttgtagtttgtcctccaaaatgaaatgaaattggtattattacagaaagatgactgagtcatattatgatagagactaatttctctgacctagtagactaaaagttttctgtagtctcttaatgagactccttttatagcatttgtatctttgtgcttaattattcttagtataaatatttagaaattgatgcatcgttttacttctatggcatgtcataaagctattttttcaaaaaaattgttttgtgtataatgtcatgcgaaaaagaattcttaaaatgatttaaaagatttagacccccctccgaaaatatcaacaaaatgaattttctaagataataagaaaatgaataaaatccccccgtagcagcaaataattgggcaaggaataaaatccgggtttggaggcagagctgaggaatacagcatgacttggttcacagagcttaccctctcccttgaagttgaattgatgagaacaaaatcttgagccttctcagaaatattccaaaactgcaaggaagggaacagaatttatttttctaatttatctctaaccttgtttcactaaagagtgatggaaatcgttactgtggagaaatgtgtgaaacatggcaagaaaataggaagagaagtaagtatcctgtgtcctcctgttccaggagaaaagccaaaccaatatttatccacctcctcctatcatcggaataggataagagccctctccttccccagtggaatgagtactggggtatttaacagtacctcagaattgatggtacatctcacgtgcagcacaaaacctttttaactctcagataaacatccacctgcctcatgccctcaagctaggggaaaaggaatggaaagcagccatatttgtcttcaaactgaagttaaaaaaacaaaatccaaagcagtcatcagatgtagtagaaagtcaagagtgtacttacactaaatcaggaaatatagcttctcaagcatgagaaagatgaatgaaaatggcatagtccatatagaaatgttctattaattataacaagaacattgataaagtaaaagaaaataaataaaaagaaattagggacataccattatacgacaaaaaaaaaaaaaaaaaaaaaaaacgagtccagtctagaagaaaatataacttaggcaaaaggaaaactcattttgtgtacattaaaagtatcattcaagaaaacttattcccaggaaaaaaatgatttgaggtaaatataaacatataattcaattatagaggattgattgcctaaagaaacaaattttaggaaaaattattattaaggaacttaacatcaagaaactataagttgaattatttaggaaggagttttgagataagcctacctagtgcatattttaaaaacatgaacctaaaagaatgctaattgaagatatatttcagtattccatactttgtgtccctggatcagcaatttaccaatagaaggaaaattatagtgggtaaaaatgttaaataagataataagtaacccctgaaatatttaattactagattttaaaataaaaaatccaaccatgatccagaaagatttgagagtgcgtcttgcaaatcaaaacgttttctctttccattattgaatcttgaagaaatgtttttaagaagaattattattcagatactcaggaagaaaggtgaactaaggtagggtgagaggtattagaagtctagtcttttaccttctatttctctacagcaatattttagacaatgggttaacatctacagattttaaaaagaaaagcatgacccactctttacagccagtcgagatgtcatctgcatattcgtctcactcactatctgtatatgcacatacacacacacacacacacacacaactccaagaaaacatcaatgattttttttcaactttctgggtttgtgatttgaggctgtttttatttacttccttccttctatttgcctgtctcatttacatttcttatctgtctaccttcattattaagaacacttaattctttgataaaaacaaatgaagtgacttttttttcctcttaaacaaaaatcttcagtttgatggtaaacgatttcactatactttaatatagggtcctcttatagcatgttttgttaataaaacaaatctatttaaatgtatgtaacatgtcaactatattcttttaaggtagatggcatttattagtcctctttgtgtttacttacaatgcctggcacatagatgtacttgatatattattttttagtaaataaatacatgagtgaatgaatgaatgaaatgataacaaacaagcaacaatatatactttcccttctactttggtctatgatataggttttgacaatacacaaactttaaattaaaacaaataatacagttttgaatttttaaaactaacaccagcctttaagaaattgttcatcacaaaattttcttcatattcttgggtatacccattcaaatatggaggttgagacactatcattttcatttgtccaaagatatttggccacagttttttatataactgcccttctgataacaggttaatgaattaggcctatcttttatgtgtttatcatacaatataatataactttattttggctaatactaatttattggttgtcgtttttctcaggctttcatgtattctaacttgcacaatttgtggtcttgcaaaagttagctgtacatgcacattctcctctaatcagcacaaaatcatcatgtgtcttttctagcacttgcactaaagaaaaaaggcctcttttgactacaatagagacaataggaaggctcaaaggttgaagacaaaagattctgcagaaattaaaggaaaagctgctagagagcatgacagctctttttgttattttctgggctgtaatttttgaaatcagttttcattttgaaagttccttaattttctcccacttcagtctaaaatatagcacacatgagtactgaagacagacagcccctcaaaatggttcaatcaggtggtatttgtaatgaagctgcaggctgttgcttggatttcttagtatcagtcttcataatcttctatatttagcggcagaaaacttgtaacagtttcttaagctcagttcactaaaatgaatgcaacaaattgtttttggaattagatattctctaggattcctagttataaatgacttgcttatagcaaatttccaatcctctatgcttcagttcctatatagctctctggatagataactctctttgcaggttcaagtgtcctttgaaagggatagaaaccatcatcgtttatttttgatattaaaacaaatgcttttaaactttttgtattattaaatgtgggactagctccaagggaaaagaagagaggaaaaggaaagaggagaggacaggagagaaagattatgttaagggaattatctatctgtaatttacgaagcctagttgacagtacttattgtcaactgtaatatacagtttccttcatcattatattaactactatattaatatattttatgcgagcagactgctgttgtaaatctttatcaatatcagtaaaaaattattttgaaatattgattttaactcacttccatttgatgatgtatatattttaagtacaattatcctgtagttttatttcaaggggttctttgttagattttgtgttctgtcattatgagttacattgtgtagcttgacaccattttttatattctgaatcagtgtgtctggcctgggaattaaatgtttcttaaatttaagaaaattcacaagtaaaagagcctccaccaatgtatctttaggaatttttaaaaataatatttcccaatttcttccatgagattatcaggttttattcttgagtcacttcagacttcttcaattttatcatttagtctttatttttgaataatatctagtttcctccaaaacagaccacttcatttataatatcaaatgtgtttttagagagttgttctttattacctaatatttttccgatttgttctctatcagttttaacaacatactgttagtcccaattttagcttatttgattatgagagatttgaattattttaagcactgatataactattaatgttctataagtaccagagatacatattaaaagaggcttagaaacaaggtattgtctcaagaggtggaaagtcaagggtcacatcaaagatatagcctgctttaagaacctctttccatctcttccatctgccatcattattcacttgtcttctccaaatcaaaagaaggctgctttttctttgaaaataatttctgaagaaaggggaagtagaaaaagtaaaagtactgtatctcactggtcagcttgtggcttgtctattcatacccattagtttttaaattttattttgagaaaaaaaaatctgaaatttataaaaaggttgcaaaaccactacaaataatttttcttaagtgtaaatttctaacctaatttcacataacttcctagtaatgtagtgtacattttctacaagtaagtcttcctcctacaaaatccagtatcacaaacaacatcatgaagttaacactgaactattaataacatctaatcctcgggtctccttcaggtttcagcaattatcttgctttttcttgtttttgaggactgaagaggtggtctcttgctgatatgtgaatggattcagttgctgttagtttgcttaaaattctcatgttaaattaggtaggcctataattttctggtcttctgagagcctgtggtttttatattattgtaatgcttacaaagtgtattttaaggtgttttctactagaagatattatatagcattggtataatttattatgaaagtattttgaaaaacacaaactggttcaggtttatggtttcttggtgggtaaatatttctattcaagtatattaaagtttctaatttatgaagtctaaatatcaaagtgtctcatttatatatctattggtttttatcagttacattgttttagataatttttcatttcatattcattttcaaatttgctttaaattgttcatacactttgcttaatatatttgtttgcagtgtctttgttgatagccttggcatctgacatttttcttgttcaatctttataaaattgtttattatatcagtcttttaaagaacttcctttttgatcttttctctagcactttgctctattttgattaatttatgttcctgttacatatttgcctatttctatttttctgagttactgtacctttctcagtaaatagcaactgtcctctgttaaatgctcaaactcaaaacttgaagtcatattttgattctctcaaaactcacatctaatccagcagaaatcctgtcagctttgtgttcaaaatattatggatgggataacttttacttctatgaatgatgggattttgaaagtcagtcctccatggggaataactaaaaacaaccctgataaatgaccaaagatataaatatttaaaagcatcagtgacttgaactctattttgttgaaaataataaaactacacctcttttctttggtttagatttgtaggaatatttttccatcccttcactttcagcctatgtatattcttaaagttaaagtgagtctcttgtaagcaggatatacttaggtctttttttttttctaatccacttagactctctaagatccatttatgtttaaagtaattattgatatgtaaggacttactagcgtcattttgctaattgttttcggactcatttgtatttcccttttcctttctttgactcaggttattttccattatgatttgatgatcttcagtggtgtgtttcagtttctttctctatatttatttactttgtgtgtgtgtgtatctactataggtttttactttgtggttactaagaggtgtacaacaccttgcagttataccagtctattttaagctgtaaataagttaagtttaattgcatacaaaaacttgacatttttgcttcttcttccaccttcaaatgttatgcttttaatatcacaatatatatcttttattgtgtatttattaataaaatattgtagcgaatgttatttttagcacttctgtcttttaaactttatattgaagttaaaaatgatttataaaccaactttacagtattagagtattctgaattgacctatatatttgcctttgccaggatattttaacttttacatattttaatgttagtaattaggctatctacatattcaatgaatctccatcaaaattccaatcacatttttcacatgaatagaaaaagcaatcctaaaattcatatagaaccacaaacaacctcaaatagccaaagcaaaattagaagagacatacaaagctggagacttcatactatctggttttaaagtatattataaagctagtcatcaaaagagtatagtactggcataaatacagacacatagaccaaggaaacataacagaaatcccagaatagaataaattcacacaattgtggtcaactaatcttcaacaagtcaccaagaatacataataagcaaagaatggtctgttttaaaaatggcggtggaagcgtgatgcgtacaactttgttcttttggctcaggattgtcttggcaatgcgggtccttttttggttccatatgaactttaaagtagttttttccaattctgtgaagaaagtcattggtagcttaatggggatggcattgaatctataaattaccttgggccattagtgtggccattttcatgatattgattctttctatccatgagcatggaatgttcttccatttgtttgtgtcctcttatatttcgttgagcactggtttgtagttctccttgaagaggtcattcacatcccttgtaagttggattcctaggtattttattctctttgaagcaactgtgaatgggagttcactcatgatttggctctctgtttgtctgttattggcatataagaattcttgtgatttttgcacattgattttgtatcctgagactttgctgaagttgcttatcagcttaaggagattttgggctgagaccatggggttttctaaatatacaatcatgtcatctgcaaacagggacaatttgacttcctctttttctaactgaataccctttatttctttctcctgcctgattgccctgaccagaacttccaacactatgttgaataggagtggtgagagagagcatccctgtctcgtgccagttttcagagggaatgcttccagtttttgcccattcagtatgatattggctgtgggtttgtcataaacagctcttattattttgagatacatcccatcaatacctagtttattgagagtttttagcatgaagagttgttgaattttgtcaaaggccttttctgcatctattgacatactcgtgtagtttttgtctttggttctgtttatatgctggattacgtttattgatttgtgtatgtcgaaccagccttgcatcagggatgaagcccacttgatcatggtggataagctttttgatgcgctgctggattcggtatgccagtattttattgaggatttttgcatcaatgttcatcaaggatattggtctaaaattctctttttttgttgtgtctctgcccggctttggtatgaggatgatgctggcctcataaaatgggttagggaggattccctctttttctattgattggaatagtttcagaaggaatggtaccagctcctccttgtacctctggtagaattcggctgtgaatccgtccggtcctggactttttttggttggtaggctattaattattgcctcaatttcagagcctgttattggtctatacagggattcaacttcttcctggtttagtcttgggagggtgtatgtgtccaggaatttatccatttcttctagattttctagtttatttgcgtagaggtgtttatagtattctctgacggcagtttgtatttctgtgggatcggtcgtgatattccctatatcattttttattgtgtctatttgggtcttctctcttttcttctttattagtcttgctagcagtctatcagttttgttgatcttttaaaaaaaccagctcctggattcattgattttttgaagagtttttcttgtctccatctccttcagttctgctctgatcttagttatttcttgccttctgctagcttttgaatgtgtttgctcttgcttctctagttcttttaattgtgatattagggtgtcaattttagatctttcctgctttctcttgtgggcatttaatgctataaatttccctctacacactgctttaaatgtgtcccagagattctggtatgttgtgtcttttttctcattggtttcaaagaacacctttatttctgccttcatttcattatgtacccagtagtcattcagaagcaggttgtacctgacttcaaactatactacaaggctatagtaaccaaaacagcatggtactggtaccaaaacagagatatagaccaatggaacagaacagagccctcagaaataataccacacatctacaaccatctgatctttgacaaacctgacaaaaacaagaaatggggaaaggattccctatttaataaatggtgctggggaaactggctagccatatgtagaaagctgaaactggatcccttccttacaccttatacaaaaattaactcaagatggattaaatatttaaatgttagacctaaaaccataaaaaccctagaagaaaacctaggcaataccattcaggacataggcatgggcaaggacttcatgtctaaaacaccaaaagcaatggcaacaaaagccaaaattgacaaatgggatctaattaaactaaagagcttctgcacagcaaaagcaactaccatcagagtgaacaggcaacctacagaatgggagaaattttttgcaatatacccatctgacaaagggctaatatccagaatctacaaagaactcaaacaaatttacaagaaaaaaacaaacaaccccatcaaaaagtgggcaaaggatatgaacagacacgtctcaaaagaagacatttatgcagccaccagacacctgaaaaaatgctcatcatcactggccatcagagaaatgcaaatcaaaaccacaacgagataccatctcacaccagttagaatggcgatcattaaaaagtcaggaaacaacaggtgctggagaggatgtggagaaataggaacacttttacactgttggtgggactgtaaactagttcaaccattgtgcaagacagtgtggtgattcctcaaggatctagaactagaaataccatttgacccagccatcccattactgggtatgtacccaaaggattataaatcatgctgctataaagacacatgcacatgtatgtttattgcggcactattcacaatagcaaagacttggaaccaacccaaatgtccatcaccgatagactggattaagaaaatgtggcacatatacaccatggaatactatgcagccataggaaatgatgagttcatgtcctttgtagggacatggatgaagctggaaaccatcattctcagcaaaccatagcaaggacaataaaccaaacaccacatgttctcactcataggtgggaattgaacaataagaacacttggacacaggaaggggaacatcacacaccggggcctgtcatggggtggggggagggaggagggatagcattaggagataaacctaatgtaaatgacgagttaatgggtgcagcacaccagcatggcacatgtatacatacgtaacaaacctgcacgttgtgcacatgtaccctaggacttaaaataaaaaaatacaaaaaaatacaaaaaataaaaatggtggtagaaaaactatattcttgtgcaaaataatgaaattgtacccttaatttaaaccatacaaaaaattagtacaaaagagactaactggtgtgagatggtatctcattgtggttttgatttgcatttctctgatggccagtgatgatgaacattttttcatgtgtctattggctgcataaatgtcttcttttgagaagtatctgttcatatcctttgcccatagaactggaaaggtaaaaaacaaactagaagaaaacaggggaaaagctccttaacattggtattggtaacatttttttaaaatataacaccaaaagcacaggcagcaaaaacaaaaataaagtggaattgtatcaaagtaaaaagtttttttttttcttcttttttgtgatggagtctgactctgtcacccaggctgaagtgcagtggcacaatctcagctcactgcaacctcctccttccagggtcaagtgattctcatatctcagcctcctgggtagctgggattacaggtgcatgccacaacgcctggctaatttttgtatttttagtacagacagggtttcaccatgttggccagtttggccttgaactcctggcctcaggtgatctatccgcctcagcctcccaaagtgctgggattacaggcatgaaccactgcatctggcccaaactaaaatgttggtacaaagtaaaggaaatgatcaactaaatgaaaaagtaacctatggaaagggaaaaatatttgcaaactatatatctggtaggggaatagtgcccaaaatatatagtgaatttatgcaaattaatagtaaaaagcaagtaaccaaatttaaaaaatacacaaaatacccgattagacatttttttccaaagaagacacacaaatggccaagaggtacatgaaaaagtgctcaacatcactaatcatcagggaaatgcaaatcaaaaccacaatgacatattgccttacaccttttaggatggctattatcaaaaagtcaaatgataacaagtgttggcaatggtgtgaaatacagggaagagttgtacattgttggtaggaatgtaaattggtacaaccataatggaaaacattatggaggttcctcaaaaaactgaaaatagaactgccatatgatccaacaattccacttctcggtatatatccaaaagaaattgaaatcagtatcttgaagagatagctgcactcccatgttcattgcagcattattcataatggccaatatatgaaaacaacctaagtgttcctcagtagttgaatgtataaagaaaatgtggtgcgtatatacaatgaaatattacttgccgtaagaaaaaaaggaaattctgctgtttgggacaatatggtgaacctaaacgacattatgccaagtgaaataagccagacacagaaagataagtactgcatggtctcactttatatgggatcaaaagaagttaactcacagaaacaggagtaaaatggtggtctccaagggctagagattgagggaaatgaaggaattttgttccaagggtacaaattttagttataaaatgaatgagttctagagatttgatagacagcataatgattacagttaataacaatgcactgtaaacttgaaatttactaagagaatagatcttaactgttctcaccacacacacaaaaggtaactatatgaggtaatggatacattaatgagcttgagtgtggtagtcacttcacaatgtatacacgtatcaaaacatcgcatgatacatcttaaatataaacaatttttatttgtcaatatatatttatttgatagggaaaaataaaaaagattcagtgaacggtggaagcaatgaggactataggaataaaaattacagataggaaataagtttttagctgtgagctgggaatttgcatccccttggggtcattctaaaccggaatgcagttttggaatctgaaataggacaaacctactgacagacaggatccttatgaaagacagaaaaacaagaggaatttttgatggtcccacagtgaagagtcacaaaattggagcactggagaatcattcacagagaaaatttatccttccatattttttgttaaattttgaagctgtgatagataggaggtaaaaacaactagagatgaatttcttgcagtctcacaggattaatgaacaaaagacccatttacagtgattcctcagggatctagaactagaaataccatttgacccagccatcccattactgggtatatacccaaaggattataaatcatcatgctgctataaagacacacgcacatgtatgtttactgcagcactattcacaatagcaaagacttggaaccaacccaaatgtccaacaatgatagactggattaagaaaatgtggcacatatacaccatggaatactatgcagccataaaaaatgatgagttcatgtgctttgtagggacatggatgaagctggagaccatcattctcagcaaactatcgcaaggacaaaaaaaccaaacactgcatgttctcattcataggtgggaattgaacaatgagaaacatggacacaggaaggggaacatcacacagtgggaactgttgtggggttgggggaggggggagggatagcattaggagatatacctaatgctaaatgacgagttaatgggtgcagcacaccatcatggcacatgtatacatacgtaacaaacctgcacgttgtgcacatgtaccctaaaacttaaagtataataattaaatgaattaattaactttaaaataaaacattttattaaatatgaaaaaaaaaagaagaagaatccatgggaaaaacagggaggggtgtaaagttctccagggagtggtgaagcaactgaagatttcttaccatttttccatgaggatagttgctgatctggaccttaatagaggctgagaatcaggatcaggacttgctagatggctatttaccaggaacaagaatttatgagaatttggattccctgtataaggttaggatgacaaaatacaattaggttattttgccctgactttcaaattcatagtgttgtaataataaaatatatattcatttgtgcctggcttcctttgtgcaacctagtgttttagagatttattaagttatttattatatcagcagtttgttctttttaatatgattgctcagtgttactttgtatgaatataccacaatttgtttatcttttctgctgttggacatttgcattgcttctaagtgttagctgttatgaattaagctctattaggttattgtacatgtgctttgtgattatatgcccagatttatctgagtatgcacttagaagaattgctatgtgacatagtagtctatgttttatttcagtagatagtgtcaaagagttttctaaaatgattgtaaaaatgttcctttccaccagcaaaattctgcgcattttcactgacacttagtattcattattttttacttaaacattccggtgaatgtgtaattataatcttagtttgaatttaatttgcattttcctgatgaataatgatagtaatgtagttgagttccttttcatatatctttggtttgaatatgctactttgtgaattgcctgatcatctctgccattttaaaatttggattgtttacctcttcctgattgttttgtaggagtgtattatgcattctggatataagccttttaccagattcttgtattgtaaatatttttttccagtctgtggcttgcttattcaattcttaatcatgattttgagaaacagaagtttttaattttaatgtaattcagttgagttttatatttgttgtcattgcttttcctgtttaagaaacctttgcgtaatcctaagtcaggaatatattctgtttttttttttccccacacaagtttgactgctttaattttagatttaggtctaagatcaaattcacatttatatttaagaatagtatgaagtaaatctcaaggttcataatttttccatatagataaccaaacattctactgtcacttacagaaaagtccatcctcttttgctctaattaggtgactatattggagtgactggaaatatgtgggtatatttctaggttttcttttctgtccattggtctatttgtctaacaatgcacaattaactcctcaattaatataactttatcatgtcttgaaatttgagaatataagacctctaatgttgttctttgctatttaagattgtcttcgttttttgggggaacttttgtttctatataagttttatgatcagctcatcaatcttcaccaaaaaaattgctgacatgttgattgcaactatattaaatttatagatcaatatttagtaatttggcatcttaacaatattgaactttcataaactttctaatgttttaagtattctttagtttctccaaataacatttcaacatttttagaataaaagtcttgtatatcttttactgcatcattactatgtgaatttttatgaaattattaatcatattttaaatttttatttataattgtttattgttggcatatacaaacacaaataaattttctacattaaccttggatccacccaacttctttaatccatttttgaattataatggtctgtagattattttgaattttctacatgaaattatatcatcttagaataaaaatttactctttctgtattagtacgtattaccacaataatactatgtagaaagttgactttaaactcactgttctaataattattcatattgtgaatttgaaaatcagagatttaggtttggtgggatttttgtttgtttggtttgtgttttgtttgtttgtttgtttgtgtcttcctgagttacattttctgtctacagttggctggctatgcagtgaagctccatatgtcccacattcattcttcagaataacttgggcaagttctcatggtgaaagtagaggtgcaaaggtaaacaagtccaattatctaagtatgtgcgaagtctctatttgtgtcttgtttacaaacagcacgtggccaaagctatgaatcacaacattaagggctgagtaaaatttcctgcccagacttggacagtacttgaaacttgtatacgaaaagaacagatataaagaggggagaaagaatttgggctgaaattcaatctatcacactttcccaacctaatagctcatatttctttttgtttgatgagttagttcatcagtacaatgctgataggaagactgatagttaacatttatgtcgtgtttctatatgtaataggaaggatctggagtacatttttgatgaatataaaattttaagtttatggttttcttctttcagctcttcaagcattttttcctactgtctaatgaacagtctgtattaattttagttttgttcctgtctttataagtttacctgttctctctttttcaaaataaactgttaattttagagccattttagatttacagaaaaattgtgaagagagtacagagttgccattacccccataaatgcaggtttttcctgttttaacatcttacattagtgtggtaaatttgttacaattaattaggcaatatttatacattagtattaaatacatccatattctattcagattttgttcataatgttcttttttgttccaggatttcatctgaataccaaattacttttggtcatcatgtcttcttaagctcctcttggctgtgacactctcagacaagaattttgataatcatgtttttataaccttgacagttttctagagtacagtcaggtatttcccacaatgagagttgtatgatgctttcctataattagactgggatgatggggatacatggagggaaggcacagaagtaaggcatggaggtaaatcatcgtggaaaagctattttatcacagtatgccaagtgtacataacattgtagatgtaaaccatgattacctggatgaggtagcaattgcagattttcttactgtaaagttattctttttcctcccttgttatatagcaccatttggaagcaagtcactacgcataattcacaattgagtaataaagatttatgcttcacctctttgaaggtagagtatctacatatattatttgacattcatctctatttgttcagtcatttattcatatcaatatggattcatggataattacatgggtactttatactttggcttataatacaataccaccttttattttactgttcagatgtttccagctttggacaatgggagctctttcaggtgactcttagtccctttgacataatacatcattgtgtttagtatgtttgtttcactttttaaatttttcttcattttcaaacactataagatgccaaaaactcatcttgcatattaactgcccacgtcttagaattagatatttctctaagaagccctgattccttttgttggtagtgtcagtcctccaaatttgttcttcttcattattaggttgattatttattctaggtcttttatcttctcatataaacttcacaaaaaattttctactttttccattaaagcctttaatatattaattatagttcattttaatcccctctctgataatttcattgtcaactttatatctgcatctggttttgatactttttttctcttcagaatctgttcgttcttgccttttgccatgtttaaagtcagacatgatgtatcaggtaataaaaactgaagtacacgtttagtgtaaaggtttttgttaatctgggtgctttaaactgtatttaatatctgatgggctgtgcttaatgtgtatgcgtctgcaggtgtcagaggtttcaaatttctccagtgaccttatttttgtgtcactggttgacttgggcttccctcagtattcctcctcaaataatctttgtctcacaactcttttagctgaaatacaatgtattattttagagccctgtttttttggtggtaagttgtgaaggagaggaagcattctgtaatattaaaattaaattttgctattttattgggcctgtgctcctggctctgaccttcacaagtgtttcttaaattccttctttcactgtgcatgaaacaggaaggctcaagagggttgcagtgagagtaagcccattcctccaagtaggataaagctatggcaaagctttatcctgtggacagtaggcgtttgtaatagaaggatgctgttagcttatttctttttcccttcttctgctagagccacaaaaggatctttttcagatcttcactatgaggtcctggtagggttcctggaggtaagacacacaatgttccacctgcccttccactccccctgcctattgcagccccagcagtttctcattcttaaactcatctgcaatcagccatcaacatttcatcaaaatgaccaattaagtgtatttatcaatttatggctccagtggttttcactccaggtaagaagatttgtactgtgactcttgattcacatgtctctacattttgtggtgataaattttatcctgcaaataatttcttctctgatgagtccgagaaaactcactgattttcagtttgttgagttttttctttggtgtagagatgagagtcacaacttccaaactccgtgtaggagctgaagtcagaagtatttattgctttaaagattttgtagcactgttttctagcaatttgattatggcactacttaatgtggttttcactgtgtttatcctccttggcgtttagtaaaattattaaataagtaaggttggagttttatttaaacctggaaaccatagatgttattttcttcaaaaattttatgcttgtcttccttttttcttgtgttctaaagacccatatgttagaccatctgatactacatacacttgaagctctgtacaatttttttcagtctttttttcttatttttgcagtatctattctaatgttaaatgtatccagtaaattttttatttttttcactctagaagttctactttgtccttttaaaataatttttattttccttcattattttcttgtataactttacattttgagcacattaaacataatatttgtttcaaagtctttccgtgataatttcattgtttgattttctactgggtaaggctcacatatttccacttcttgtcatcattatacctattttacgggaattgcaatattttgaatgtatgttgctgtgtgttaggtctgttgtcttcctttaaaatgttggattttgtacaggcatgcagctgttacttgtggatcaatttgattacttgcaggcttattttaaagccttttgtaagagctcatttggaatagttcttactctggggatgggtaatccctactaccatactatagttcttttctggtttctgctgaatgtactgagtgatcaacaaatattcactccgcctttccagagctcaggtggctcacagcactatgaaagctgagaagtttttacctttctgcttactaggggtcgttttactaatcttaaacttccacctcatccatgcatagcttagtattcaaggggatccctgtacagatttctagggcttgtttccttagtaattccctcccctctacagcatctccccagtttttagtcatttcaccctccctcaaatctgatccctgttttctcaactcaacatatccactgcgctctatttgtcgtccatttaatatcatggttaagtgtggttaagaatttttctctagaaataaagctagtgggatcctggggctcaccctgcttatgtggcttctctcagtgactacagtcttttgctgcttgctgtccaaattctaaaaaaatttctgtcctgtatttgttcagctttttaattgttttggtgggaaggtaaattcaaccattttacttcataatgctcacaagctaatttttactttatgtgctgccgaagtgaacactccagaagctaattttaaaatcaaacttaagtaaaaataaaggaattattgaccatcagctaaatatttctttattatatgaggttctatcttaaaagcaattttctccctaaggtaagaaatgagattatgaagaacagtaagtggttgtaatctcttttctttttccttttttaatatggtgtttcaaatttaaacaatatctcttcactttgatatgaaaaataaggacattagatcctttgcctcatgcccttagtttattaattccattttatatgtttcataacattaactttgattatatagccacaacttgagaaattatcttgtatctgttctctatttaaatggaatcacatgtcatctacaatcattttatgatggctttccattccactattattttgacttcttatttaccttttaattagctcaaatttatcactcctgggtttttgttttgttttattgtttataagaaagattcatgctatattactcattattattcatggggttgttttttatagttgagcatctacaactttatcctcacaccagaatgaggtttgagctggatcacaattggttgtctttagaacttggtaaatactgctttttcttgatgttgtgtgtctgattttacttttttaaaatactgtactttttgatttacagatacagttctttcttcactataggagaaattatcataagtatttaaatgtatctgcgatttcatttaatgactttcctacttcaaacgtaactattttcattaggcttatctatattctggatttatcaggttctttctgaatggcctaattgatttgccttctttatctacattggttagagttattccaatctttttctctatgatgagaatttcagaagtaactaaagttttggctgtgtttatttgtcagtttgagattattgttctttagtgattttctatgtttttgcaagtctgcaatctcaattaaatatacctttcaatcctatgcttaaagtcgaagcttactaaattagtcataccaaattattctacattttgcagtgattggatataactcttgattcgtgaatattttcttcagcactgtgtacttcgtctacctttttgcatactatgctcttgctatttgttcttgtttgatacttatgaagcacaattgccacaccatttttttcttatattgctcacttttgggcagcagttttcacattctctcttctcactttttttttttacatctctcaagagagatgtaaaaacatttccttgaaataaacattaaattttagtttgttattttgtgcagtatttccccttgtatagcctaatggtggtggactgtggaaagactttaccaagaaaagatgagttgaaatgtaagcatttatttttagaatatcttaaatccattctaattgcttttgtttgttttgtttattaaagtcccgtaccaaggttttgttcatctactctggggggaagatcccataactgtgagagaacattttcaagccatggattatttctgtagctttgtgtgttaagtctaagactacagttttgtcaaggaaacatagtcccatggtttacttctcccccttctctacctccctccatctctcagaactattcctttatatcattatgttaaacatataaaaagactgtggttttttgaaaatggcacttgattgtgaaacaagagctctaatttgaagacctgcttttgacactagctatgtgacctgcagcaaatttcgttctcatctggaaaatttttgcagaggaaggtggtgagagtaaagtgatttgaacaatatgatttccacagtttaatttagctgtagtgttccataactgtgaatttctggacctcctgagtaacggctaaatataaagttggctctataaaaacttatgtgggtaaaaaatttgcaaagaagtaaatataatattcatatgtattatctgcatgatagtaaattccttggtatttataggtatctgagtacgttcagataccctgtagcagccttaactattggagcttttatttatatggatatatagacaaaattaagtgagaagctgaggaattatctgataatttagtctcgctaatagttttacctcaaacataagcaaatgggctttggagaatattattttgtaagaaaaccacttgagtttccatgtatacacaaagttgatggctacaaataagctaatagacaatgtttggttaggataaggagtaagccaaactacctcacagccagatcatttttgccttgattgacatctgtatacctctttcttggcattttgcttcaggttttaaaatggatttctctttttactagcctactcctttagagtgatggacactatgttgtaaatgaatcctttgtgcaggttcttttcagttaccttgaaaacagctccacattactttgcatttaggaataataaaaagagggatttgggaacttgcttttatcatgtggtagtggcatcatacaatattcccagcctgatcatgcatgagtgacttaagtggaaaatttattatggggaatattttccttacttaaaacactctattcttacagcgaaacagtaagaaagatatggttctatttataaacaactgaagcataatatctgcaatacatcacgtaaaggtataatcactgtcaaagtgccaaggtaccatcacagaaagtgactgctgtaattgacagagatggtgatcaggctccagaaccatttgccgattgcatattcatgattccactttgtaatatgctacagttcctctgtgagttattctaaatggatgtttaaacatcactagactgacactatgtattttgaaatttgcaagtctaatctttaacacctttctttctgctttgtctcagaatgtctaactcatgaaattggaacttagctaagggcctgaataggaggtttgtatgtatctgccattgtcacagtacagtcagataaattcggctctttttatgaattcagtccttaaattctttttgcaaccttaaagtaaacattggcagtcagttaaaactaacttctaaatgcaatggttctcttatcagcccctttacaaggataatgtaattttattttattttattttatttttttattttattttatttttttattttattttattttattttattttattttatttttgagatggagtctcgctctgttgcccaggctggagtgcagtggtgcgaattcggctcactgcaacctcgccctctgggttcaagctacatggcaaattttttagtctctcactgaaagatacttacatagctgtgagtaataattatcttaaatatcatgtccctagtagaatcatctctagtgttttagttttaaacccatgtgccatgtggtgtttcccctcattttgacaaattgattttagaatatattgagaagatctataaattatcctcaaataaatagaatttttacttcaaaacttaaacatatcagctttcccattggaataaaatgcaaatactatacagaatcaaatataatatgtcccaatactgaactttaggtttaatttattttcctcactatggtgagaaaaacagactgtatttataaagaaattcataaataatacgaaaaaccactttagtaggctgaagtagaggcaaaaaggagatgtggaaagccaataatgcatttcatggcattcaaaggaaatgggaattaagttttgtgttttttctaaattagggtatattcaaaagttcattcatgttaccaatttaatgtaatacattgcagttcaggttggttaataagtttcaaaagtaatataaattaaacacatacttccattagtttcaaattttgatgtatttcacaagtgctttaaatctcttaagaatatgcacataaaaatatattagttgtttatattttattaaaatatgatataactatataaaagtatataaatataaaatgatatatacaagagtataaatcaagaaggcacagctcagtgaatcttcataaagtgcataaaaccaataaaaccataacactatgtatttttaaattagtttataaaaaaattatctgattcaagaaactaaaaataaaggaatattttaagtagtctgtttttccaaattcctttcacttaacttgacagtcaagaaatcaggttaaaattttcttcaggctaatgttagagtaaaaggatggtacttctttaggtcatttgtctgtgagagacctggacttaaaccaagccaataggctcttctgtctggcagtctggcaaagctgtgttgatagaagcaattacgggtgagtcatgttaaccttaatgaaactcgagggataatcctggaacccaaattatagtttaatttctacaattacaattaatcttcccaattaggtggacatcttaatgttcatattttcctccatagccatatgcagatgctgctttctcatctttatatgccgtatgcacctgaaaacttccataattatttcaaaagcactgaagtccatcttttgttagaaagactatttccaaattatttgaatcagaaaaaaacatttggaaaaattcatttataaaagcaagttgataccattgggaggaaatttctctttcatttcccttctaggacctattgctattttttattcatttattcatccaagaaacttttattacatatcctttatttgcctagcatcatatcaggtataaacaaaattttaataatggcagagtatttgatcttatagagcttacagcctctgtaaaggtgttgtgaaggtttccattcatccatttattcaacaaataattactgaatttttgttatgtgccaggcaaattacaggcattttgaataagacattgaacaaaacagacaaaattcttttttcagagcttagattccaacaaaggagactgattataagcaaagtatacaaataagtatgcaatgtgatatgctgattatatctttggttttaattaattatttcactagagccaagcctcttttagtgtgacattgcacaacagttgaatctgaactagtttttaacttgttttggaaaatagaatgtgatggaagtgacagtgtggtggttccaaacataggcctcaagaagtcttgtagagactgggaaggattgtggggagggagggaaaagtcaagattgtttgtgggtgcaaaaatatagttagaaagaatgaataagatttagtattttatagcacaacatggtgactatgatcaacaataattcagtgtatattttaacataactagaagatcagtattggaacgttcttaatacaaaaagataatacttgaggtgatgaatactccaattactgtgatgtgattattatatattgtatgcctatatcagaacatcatatgcactccacgaaagtatacacctacaatgtgcccatagaaataaaaaattaaatatatatatgaacttattcatactaaaaaaaaaaaagctttgcacatttctactctttctgaatgctacctctcccatgcgagcaagctgtaaggtcatccttgaccacactgttcccacccaacccatccgcagacctcagataatatgaatttagctaagatcactgagttaataataatcattattatatgccattaaggctttgtgattatttgttatacagaattattagggcaatatataatggacacatatagaacataaaacaatgaagatttcacaggagaaaaaagtaaatcaaaacataacagtcaaaacaataataaaggagaagaataaagttggaggactgacaccacccaacttcatggcttactataaaacctcagtaatcaagacagtgttgtattggcaaaaagaaaatagacaaataaatccatggaacagaatacagagcccagacataaacccacataaatacagataattaatctttgacaaaggagaaaaagcaatgcattggagaaaagatagtattttcaaaaatggtgccacgggacattcacatgcaaaaaaaataatctagacacagacattatacctttcacaaaaattaactcaaaatttatcacggaattcaatgtaaaacacaaaactataaatctcctataaaataatataggggaaaatctatatgaccttgggttaggagatgactctttagatgtaacaccaaaggcacaatccatgaaagaattgataaacttgatttcagtaaaattaaaaatctttgctctgtgaaagatagtgtcaagagaatgaaaagataatgtatagactgggagaaaagatttgcaaaagacatatctgataaaggactgttaagatatacaaaaagctctgaaactcaacaataataacatttttaaaatgggccaaagacaaacagatacctcaccaaagaagatatacagatggcaaataagcatataaaagatgcttcacattatatgtaagcaaggaaatgcaaattataacaacagtaggatgccaccacagacctattaagatggccaaaatccagaacactgacaacaccaactgctggcaacgatgtggagcaacaagaactctcaatagttggtgagaatgcaaaatggtgagctactttggaagacagtttagcagtttcttccaaaactaaacatactcttatcatagatctaaaaatcacactgcttgatatttacccaaagaaactgaaaaattatgtccacacgaaaacttgcacacagatgtttatagcagctttatttataattgccaaaacttagaagcaacccagatgtccttcagtagacaagaagataaataaactgtgttacatccagacaatagagtattattcagagctaaaaagaaatgagctgtcaaaccatgaaaagacataaagggaatgtaaatacatattactaagtgaaagaagccaatttgaaaagctgcatactgtatgatttcaactgtatgacattctggaaaaggcaaaactatggagacattaaaaagatcagtggcgtcaagtagttggggcaggaaaggatgaatgggcagagcacacaggatttttaggtcagtgaaaattctcagaatgatataatggtggacacatgtcattaacatatttgttgaaacccatagaatgcatagcattttctccacagaggtgagactttgattatatttttaaaaataattacatattcttcatgcaaatatatgtttgaaccatgctgagggaaagcattacaaactcagctaggaatacaacatagaacattcaatgggttattaattattctgtaggtttgaagtatgcaattctgaggatagattgagaatggaggaaataacagaacttaaccttggagtacagggtagcgaacatccaaaatctgaaatgctccaaaatctgaagtttctgttttgtttaacttgtattttagtttcaggggtacatgtgcagatttgttatataggtaaacttgtgtcaccgggatttgatggacagattattttgtcatccaggtactaagcctggtacccaatagttaattttcttaaacctttccctccttccatcctcccactgctggtaggcccaagtgtgtgttatcctctttgtgtccatgtgttctcatcatttagctcccacttataaatgagaacatgtggtatttggttttctgttcctgtgttagtttgctaaggataatggcctccagcttcatccatgttcttgcaaaggacatgatctcattctttttatggctgcatagtataccatggcatatatgtaccatattttctttatttagtcttctgttgatgggcatttaggttgattccatgtctttactattgtgaatagtgctgcagtgagcatacacatgtctttatgacagaatgatttatattcctttgggtatatacccagtaatgggattgctgggttgaatggtagttctgtatttaacttttcaaggaatcgccacactgcttttcacaatggttgaacaaatttacactcccaccaacagtgtataagaattcccttttctctgcaatcttgccagtatctgtaatttcttgactttttcataatagccattctgactggtgtgagatggtgtctcatcgtggttttgatttgcatttctctaataatcagtgatgttgagctttttttcatatgcttgttggccacatgtatgtcttcttttgaaaggtgtctgttcacattctttgtccactttttaatgggattgtttgttttttgcttgaacgtttaagtttcttaaagatactggatattaggcctttgtcagatgcataggttgcaattactttctcccattctataggttatttgtttactctgttggcagtttgctatgcagaagctctttagtttaattagatgccaaaagtttttgcttttgttgcagttgcttttcgaatctttgtcatgaaatctttgctcattcctatgtctagaatggtattgcctaagttttcttccaggcatttgatagttttaggttttacatttacgtttttaatccatcttgagttgattttatatgtggtgtaaggaaggggtccagtttctgttttcttcatatcactagccaattatgccagcaccatttattgactaggaagcctttccccattgcttgttttgtcagcattgttgaagatcagatggtcttagatgtgtggccttatttctgggctctccactctgttccatttgtctatgtttctgtttttatatcagtaccatgctgttttggttactgtagccctgtagtagagtttgaagttgggtagttttatgactcctgctttgctcttcttttcttaggattgccttggctagggctctctttgggttccatatgaattttaaaatagtctttttctggttctgtgaaacatgtcattggtagtataataaaagtagcactgaatctgtaaattgcattgaccatatagccattgaaatattaattcttcctatccatgagtatggaatgtttttacatttgtttgtgtcatctctgatttccttgagcagtgttttgtagttctcactatagagatatttcacctttctggttagctctattcctaggtattttattctttttgtcacaattgtgatggggttatgttcctagtttggcctttgtttggctgttcttggtttattggaatgctagtgatttttgtaccttgattttgtatcctgaaactttgctgaagttgttttccagcttaaggagctttggggctgaaactatggggtttgctagatatagaatcatgtcatctgcaaacagggatagtttgacttcctctcttcctatttggatgccctttctttcttttggctgattgctctggtaaggatttccaatattattttgaaaaggggtggtgagagagagaatccttgtcttgtacttgtgttcaaggggaatgcctctagcttttgcctattcagtttaatgtttattttgaggtatgttccttcaatacctagtgtgttgagagtttttaagaaaggatggtaaaatttattgaaagccttttatttatctaatgagatgatcatgtggtttttgtctttagttctgtttaagggatatatcacttttattgatttgtgtatgttgaaccaatcttgcatgccagggataaagcctacttgttcatggtggattagctttttgatatgctgcttaattttgtttgctagtattttgttgagaatttttacatcaatgtttattgaggatattggcctgaagttttacttttgcgttgggtctctgccaggtttggtatcaggatgatgctggactcatagtatgagttggagagaaatccctcctcctcagtttttggaatagttttagtaggtatggtactagctcttctttgtacatctggtagaattcaactgtgtattcatctggttctggtcattttttggttggtagactatttattactgattcaattttggaacttcttattggtttgtgtagggattcaatttcttcttgtttcagccttaggagggtgtagtatccaggaatttattcgtttctttgagaattctagtttgtgtgaatagaggtgttcataatagtatttgatggttatttttaattctgtgggttcagtagtaatatcccttttgtcatttctgaatttctgattgtgtttacttggatatgctctcgtttcttttttattagtctggctagctatcttactatttttttccaaaaagcatattctggcttcgttgatctttctaattttttgtgtgtctcagtctccttcagttcagctctgactttggttatttcttgttttctgctaccttgggggttggttttctctttcttctctggttcttttagttgtgatgttaagttgtcaattagatctttctaactaactttttgatgtgggcgtttagtgctataaattatcctctgtacactgctttagttgtgtgtcccagatattctggtatgttgtatctttattctcattagtttcaaagaacttcttgatttctgccttaatttcattatttacctaaaagtaattcaggagcagattgtttaattttcatgcactgtatggttttgagtgattttcttagtcttgaattctatttttattgtgctgtggtctgagagaatggttggtattattttggttcttttgcattgatgaggattatttcatgtctgattgtgtgattgataaaatctgaagtttctgagcactaacaaacatgatgctcaaaggaaattctcattggagcattttggattttagatttttgaattagggatgttgagccagtaagtacaatgcaaatatgccaaaattcaaaagaatccaaaatcttaaaaacttcttgttgcaagcatttagaataacagatacttaacttgtatctgtgatactgaagttagataatgaagaacgttgtaaaccattttaaagaattataaatattatagtacctaatggggagaaagaagaagattttgaacacaagagtgacagtctgagttgcatttttaatagtgtggagcgtggacataggagtaagtgaaactcgagacatgagaaacattgagaggctatttcaagagtcttaatatggaataatggggatgtagacattatccataggaaggaatatatttacacaggaattgtaaggctatatttgtttttaaactcttactgagtatactttccctaactcagctccagacatatgggtctctctacttttcctcaatatgggagatatgtccctaattcagagtctttatataggctgtaaatcctggtaccgatgtggcctatactctcttcttcattaaagtattgcttaaatcttatcttctcattaagtcttaccttaagtcttcaattaaagttgcacaccaccatttcctactatggtagtttgcagtactttttcaaaacactttttcaaaacattcttttattgcaatctaaaaacactcctctgttagcgtgtgacttcaagtgcctcactgtaagagaaacaaatattctcgtgccagtgacactggatttggccatgtgtcttactttggacaatggactgtagaaagacaaaatgtatatcacattctaggctaatctttgaatattcctctgaaatattcagtttttatttttttaaactcttccattagtatagcatttaagcctggatcctaaaataaagaagacatgtagagaagaaccataggaaactagagctgttacaatctaattagttatgagagagaaataaaactttattcttatatccatttgttttactaaaatataaagagatgtacatcaactgatatagaaaatggtaagtagaagtaggtttctttcataagaaaaatcctacaatacatgggatcaaatgtggtcttaagtaagctcctgttgaacactcaaatgatagaaagccatgttatccagtgacagaacattgagtaaaactgtcacctgtagtatttagtacagaaaatgtagtaaaactgttactgtgatatgtcacctaaggaagataataagttgatggttactgggcttcacatagtttctatcagctacatctgattgggtatttaaaaaacaaaaaaaaacaaaaactcagaaaacaattaactggccagcaagcatgctaaaagggaaaagagaatccaaaaatttcagtagctacagtatagaaagatgcaactctcataacaaaaaggtaagaaaaaaatcaagaaatgctttgagaaacaatgacaaataattaaggcaaccttaaagcaaaagccaacttgagggcatgccaatcttattatttgctatagcctctgaataatttcagttgattcatgataaatcctttcaattgactaaaatggcttagtgaaaataaactaatagtgagcttctttcacattatccttataaattaaacataatgagaatgaaatttatagaacatatctttaatctttaaaatactctatactttttgatgtgtctattggcatgtagaaaaaattgccatcaagtaggtaaaaagccaaaaaaaatcttttttcagtgaattgcactgccaaatgaaccatcagctaaaaatgaacgactgttattatcaaattttaaaataactcttggattcctaaacttctacaggcaaaaacaggttgagacattaacttattccaatagaggatatagtctccttttcagatgtggccaagaaggatactgaacttcaagggaagagccaagattcaaaaagaatggatggaggtcctcctcctatgcagtagaagttttactttcaagaaaatgcttttcatccaacatagaagactcttgcaaatatctgtatttcttggtttcagaatttttacataccagtaatggcaatgttcctcctattctttccttttctcaaaggaagtgtttattgtcataaatatgtccttgtttctccattatatcttaaggatggagacataaccttccattttattcacatatctttagactaagaaaagtgatatgtaaaacatatttaaaattgtggacattaagtgaatattgaggtatctttgtatctttcttagtgatggggcgaatgatgttgaataaaaaaggaaggaaacttaatatctgttaccaagatagtagattctggtatattagagtattagataagactatgtatgagagtgttgctcccattatatatccacctcacctgactgtaggaatattgtatttatgtttcttccttttcttaaaaaatggcattctttctatctgaatactgaaattaaccagacatgtggagcagagccagagctgacctaccactgctgcagatcatatcaagtgagagtgagaaatatttctgttgcaaatcattgagtttgttaaagtcgtttgttaccacagtaagaactaacacacccgctcaatttcaaactcattttttcacaattccttttaatttgatctttatttttttattaatgtgatttttctcctagtacatattactttcaacatccaatatagtttatgcatttataatggttattgtgaactgtatgaccattttattagattataagccataagaagtcagggattctttcacattttgtttggtaatgtatctggagtacaaaaagcaaaatatggacttaaatatttgtagaatgaatgaatcatgctgtcataaaacttgtggcaaataaatgctagggaaaaaatttggaattaagctcatcctgtagaggtaacctatattaaaaatttgaaaattctaacacatagcaacagttatcacgaatgttattggtggagggatagaaaaatagatcaatgaaacagaataaagaaaccaaaaatagatttttgcttaaccgatttttgaaaacaggtgcaaaggtaatgaaatggtagcagcatagccttttcaaaaaatggtgctagaagaaatgtacatctagaggcaaaaaagaaaaaaaatgatatctttgacataatattcacaattatttttaaaaactcagaatgaattatggatttaaatgtaaaacatatcctgagactttgctgaagttgcttatcagcttaaggagattttgggctgagacgatggggtttttctaaatatacaatcacgtcatctgcaaacagagacaatttgacttcctcttttcctataagaataccctttatttctttctcttgcctgattgccctggccagaacttccaatactatgttgaataggagtggtgagagagggcatccttgtcttgtgccgattttcaaagggattgtttccagcttttgcccactcagtatgatattggctatgggtttgtcataaatagctcttactattttgagatatgttccatcaatacctagtttatttagagtttttagcacaaagcaatgttgaattttatcaaaggccttttctgcatctattgagataattatgtggtttttgtcattggttctgtttatgtgatggattacatttattgatttgtgtatgttgaaccagttttgcatcccacagatgatgtgctgctggatttggtttgccagtactttattgaggatttttctcatcaatgttcatgagggatattggccttaaattttcttttttagttgtgtctctcccaggttttggtatcaggatgatgctggcctcataaaatgagtgagggaggagtccctctttttctattgtttagaatagtttcagaaggaaaggtgccagttccttgttatacctctggtagaatacggctgtcaatccatcccattcttggcttttttttggttggtaggctattcgttcctgcctcaatttcagaacttgttattcaatttcagaacttgttattggtcttttcagagatttgatttcttcctcgtttagtcttggaagggtgttttagtcttgcaagggtgtttgtgtccaggaatttatccatttttctagattttctaggttttttgcgtagaggtgtttatagtattctctgatggtactttgtatttctgtggtatcaatggtgatctctcctttacaatattttattgtctccatttgattcttctctcttttcttgttagtctgtctagcagtgtatctgtctattttgttaatcttttcaaaaaaccagctcctggattcattgagttttgaagtgtttttcatgtctctatctcctacagttctgctctgatcttagttatttcttgtcttctgctagcttttgaatttgttttctcttacttctctagttcctttaattgtgatgttagtgtgtccattttagatctttcccgctttctccagtgggcatttagtgctataaatttccctctaagcactcctttagctgtgtcccagagattctggtatgttgtgtctttgtcctcattggtttcaaagaacatctttatttctgccttcatttcgttatttacccagttgtcattcaggagcaggttgttcagtttccatgtagttgtgcagttttgagtgagtttcttaatcctgaattccaatttgattgcactgtggcctgagatactgtttattatgatttccattcttttgaatttgctgaggagtattttacttccaattatgtggtcaattctagaataagtgctatgtggtgctgagaagaatgtatagtctgttgatttggggtggagagttctgtagatgtctattaggtccgtttggtccagagctgagttcaactcctgaatatccttgttaactttctgtctcagtgatctaatattgacagtggggtgttaaagtctcccactattattttgtgggagtctaagtctctttgtaggtctataagaacttaatttatgaattttagtgtgcctgtattgggtgcatatatatttaatatatatttaggatagttatctcttcttgttgcattgatccctttaccattatataatgcccttctttgtcttttttaatctttgttggtttaaagtcagttttatcagagactagtattgcacctccacttttttgtttgtttgtttgctttccatttgcttagtaaatctccatccctttattttgagcctatgtgtgtctttgcatgtgagatgggtcagctgaatacagcaaccgatgtgtcctggctctttatccaattagccagtctgtgtcttttaatcgtggcatttagcctgtttacatttaagattaatattgttatgtgtgaatttgatcctgtcattatgataccagcaggttatttcacggacttttaaaggagaactacaaaccactgtttaaggaaataagggaggaaacaaaaaaatttccatgctcatgggtaggaagaatcaatattgtgaaaatggccatattgcccaaagtaatttatagattcaatgctatccccatcaagctaccgttgactttcttcacaaaattagaaaaaactactttaaatttcatatggaaccaaacaagagattgtatagccaagacaatcctaagcaaaaagaacaaagctggaggcatcacactacctgaatccaaactatactacaaggctacagtggccaaaacaccatggtactggtaccaaaacagagatatagaccaatggaatagaacagagccctcagaaataacaccacacatctacaaacatctaatcttcgacaaaactgacaaaaacaagcaattgggaaaggacttcctatttaataaatggtacaaggaaaactagctagccatatgtagaaaactgaaactggaccccttccttacaccttatacaaaaattaactcaagatgaaagaaggacttaaacatcagacctaaaaccataaaaaccctagaagaaatcctaggtgataccatttagggcataggcatgggcaaacactttatgactaaaacagcaacagcgatggtaacaaaagccaaaattgacaaatgggatttaattaaactaaagagcttctgcacagcaaaagaatctatcatcagagtgaacaggcaacctacagaacgggagaaaatttttgccatctatccatctgacaaagggataatatccagaatctacaaggaacttcaacaaatttacaagaaaaatacaaccccatcaaaaagtgggcaaagtatatgaacagacactactcaaaagaagacatttatgcagccaacaaacatacgcaaaaaagctcatcatcactggtcattagagaaatgcaaatcaaaaccacaatgagaaaccatctcacaccagttagaatggtgatcactaaaaagtcaggaaactatagatgctggagaggatgtgaagaaataggaatgcttttacacttttggtggcagtataaattagttcaaccattgtggaagacagtgtggagattcctcaaggatctagaaccagaaatgccatttgacccagcaatcccattactgggtatataaccaaaggattataaattattccactataaagaaagacacagcacacaaatgtttattgaagcactattcacaatagcaaagacttggaaccaacccaaatgcccaagactggataaagaaaatgtggcacatatacaccatggaatactatgcagccataaaaaaggatgagttcatatccttggcagggacatggatgaagctggaaaccatcattctcagaaaactaacataggaacagaaaaccaaacaccacatgttctcactcataagcgggagttgaacaatgagaacaaatggacacaagaaggggactatcacacactgaagtctgttggggggtagcaggataggagaggaatagcactgggagaaatacctaatgtagatgaggggttgatgggggcagcaaaccaccatggcacgtggatacctatgtaacaaacctgcaagttctgcacatgtatcccagaacttaaagtataataaaataaataaataaatgtaaaacataaaactataaaagttttagggaacaaaatgaagaaaattttcaggttttagggcttggcaaagaattctgagattggacaccaaaagcgtcatccataaattgaaaaactgattatctgaatctcatcaaaatttaaaacatttgctctcccaaagaccctgttaagaaggtgaaaaggccgggtgtggggcctcaggcctgtaatcccagcactgtgggaggccgaggcgggtggatcacgaggtcaggagatggaggccatcctggctaacaaggggaaaccccgtcactactaaaaaaaaaagtacaaaaaatttagccggcgtggtggcgggtgcctgtagtcccagctactcgggaggctgaggcaggagaatggcgtgaacctgggaggtggagcttgcagtgagccgagattgcgccactgcaccccagcctgggcaacagagtgagattccatctcaaaagaaaaaaaaaaagagggtgaaaagaataaactagggaacaggaaaacacacacacacattactaaaaaaaggactggtacctagaatatataagacctctcaaaaatcaaccttaaagtaatcaaacactccaaatagaaaatgtgctggtattttattgaagaagacatacagatggcaaataagcaaaggaagtgatgttcaacattacctttaggcaaatgcaaattaacatcacaaccagatatattagcttacctgcctgaatggctaaattaaaaaataaatgctggaggggatatagagaaattgaattactcatacactacctgtgtgaatgcaatattgtaaggccaatattgaaaaaacaatttggcatttcttataaaactaaacactcaattaccatgtgattaaacaattgtacccttgggcatctgtcccacaaaagtgaaaactatgtgcacatgaaaacagtcacagcaggccatgcgcagtgactcgtgcctggaatcccagcgctttgggaggccgaggtgggtgagtcacgaggtcaggagttcgagaccagcctgggcaacgttgtgaaaccccatctctactaaaaatacaaaatattagccgagtgtggtggcaggcacctgtaatcccagctactcgggagactgagacagaagaatcacttgaaccagggaggcaaaggttgcagtgagctgagactataccactgcacaccagcatgggcaacagagcaagagttcatctcaaaaaagaggaaataaataaaaattaaaaataaaaacaattatagcagttttacttataacagccaaaaattggaaacaacttggatgtccttgtacaggtgaatggttaaacaaattgtggtatacccatacagtggaatgctaattagcaataacagggaacaaattattgacataagcaacaacttggatgaatcttaaggaaattctacagtggaaaaaggcaaaatcaataatatatatactgcaaaatcaataatatatatactttatgaatttatataacattcttgaacatattatttagatgaataacatattagtggttgttagggatcagataagggttggtgttggggaagggaagtggctgtggctataaaagtataaaaagggatctttctttgtggtgatggaactgtttttttatcttgactgtagtggtagattacagagaagtaaacatacacacacacacaactgtagtggtagattacaaagaagtacacacacgcacagagtactttaaagcaggttaaatctgaataaaattaatgtcaatttcacagttgtaatattgtactgtagttttgcaaaatgttaacactggaaaaactggccaaatagatatcccatgtacccatgggatatctctgcagtatttcttacaactgcatatatatactactgcctcaaaataaatagcttcgttaaaaaatggttaaatatataattaattattatataaatcatcaagtctacttctacatatttacccgttagaaatgataatatatagatatgtccacaaaataacctgtatgtaaatgttcatagcagtattattcataatagtgaaaatctaaaaacaatcaattatctggaaataagtaagaaagagtgtgagaaaatatcttggtgaagagtattctacctagcaagaatagaaaatatacataacctaacatgagatccagattggtatattcaaggactatccatgaggtcggtgtggctggggtgagaacctaaatgagtggtaagaaacaagggcagatagacacacaatggatgtgagaggtgtgggcagacatcattcaaagtcatttagactcttactctcaataaagggtcagccacattcaaagtcatttagactcttactctcaaaaaagggtcagccactgggggtttgggcagaagaatatgacctaacttttatgttttaatgagatttctttacatattgtgtgaaaataatgtcatatcatactatatgggaaatttttcattattttaagacctttaaattcaggttttgtttctataaaaatggtattttttcaagttccaggaattaccttgacaatcaaaatgttctcctgtgagcacatttcagagaatatccattcatccactaaaatgaaattctcacttaaactttctattatcatgacattttagagataagaatttagttttacagattccaaaactaataacataattacaaaaagacaaaatcagaataactgcaacatagttgtaaatgtatataatcccccaaatgacttggaaatgttgatatatgttacacatttgagggaatttggctgatgtttttaaaaatttcttttttgttttgtatgtgaataaaaatagcacagacccaagaacaaccacatggtgccatgagagaacagaagtcacaaagcacacaattaacaaaacagtatcaagtcaatacaaatcacttaattttgctaatgactgtcatgcatggtaaaaatagacaacaagctcccttctggcagaattaacaagcacactacctaatatggaacatagaaattatagtaaataggagatgagaaaagaacaagaagagaagtaatgaggaagaggtggaggagagaactcatttaccatagcttatacacagaccccatcgtttagttcatcagtaacatcgagactgcgatgtgatggaagaaaactgcaaaaaaacaactgctcaacacacacatcccggcagggtccaaaattaggtcacagcaatcccaaacaaacaccttactgagaaaaaaaaaaaaaaaaagggaaacctattgacaactattctataaaactcttatccaggtagttattaaggagtcagtttgtattttcaagtcttgtcttgaaagccctagttttactttgttttctcttatgaactacttggattccttctctttaaaaatatcaaaacaaatatctttggtgttttcaagaaaaaaaaaatgttcttccaaatgaagagcacatttttattcctttttaaaaatgtattgactttcatataattgtatttttgcttattctgggggaaaaattctaattatttcaatcagcttttctctcactggtagcagaaaaacccatagctatttcacatcaggttaaggcagtaatgttcagctaaaaattaacatttatcaacctcctccatgactgccccccaaattgccatataaatacatattcatttgccaaatatatcatattcattttcaaatatttcaaacatttgcagcccctactgtgggctgcagatccagggacagatacaaccaagtttctgccatcagcttagtaatccattgtgggagacaagcatatagatacatataaaaatacctaattcagtttaacatttacttacccaaaacaccttccagaacccgcggattaggtggtttctcttatgtaacactgctaattttatggaattgaaagtcattcactcattcatacaataaataattctggggtgctacttagtatatgccaggcatttttctaattactgggggtgcctaagataaaaaacaaatctactgccttcattgagcttaccttctgttgctggggagagaaaagcaataaacagattatataatctctgatatactagttgttatgaagaaaaccaaacagggcaagggaatagagagtcattggtgattgctgtagatagataaattacaaaagccccatttacaaaagtgacattattcaaagatctgaaaaaaattatattagttttctaatgttactgtaacaaattaccacacagtgacttaaaacaacacaaagttattatcttataggtcacaagtctgacatgggtatcattggactaaaatcaagatatcggtagggctgtattgaggtcctcgaggaaaaataggtctctttgccttttccacctctagaggttgtccacattctttggtatatggtgtctgttacccatctttaaagccagtgagtcaagtttcttctcacatttctcttattcttattccagcatcacatctttatatgccattctccccttttcaaagtccttaatgttaatcacatccccaaaattccttttgccatgtgtagtaaaatattcacagggtccaggaattagaccatgagcgtctttggtgtgggctgtattattatgtctatgacagaaataaagtgatatatataaaaatctaggggcagatactcaagtcagaatagtaggcaaatgcaaagacattgaaggaaaaattgatataatagcagatttagttcctgattctaagtaagcccacattgaacattatttggccaataaataaatgaatgagatgtgttgcccacagtagtaatcaatgcattttctgttgtctcccttctgccctttttctgtgttctcatccttcctctctcttctctctccctctctccctcccactctgttagaaacaagggtgctataaacacttaaaaatcaaatgcttggggaatgccagtgatgtccttgggatagaggcacagttgtttgaaaatattacaggattcactttaatgtcaagaaatcagctctagtctaatgatgcttcacgatgcatgtcttgccagtttttaggttatgatttggccagaagaagtgctgcaaaaacatatagaagattatttgctattcttttgatctacttccatatggtttgtaaaattcacacttggattgattggttcccccaagaattttcaattttatcagatgaagctataccctgtagcccttgtcatgcttgtgaagaccacacaccaaatatgaagacaatgttactacttatcccttccaatttctcataagaatgtcaaatatcttacttcatattcaactttcactaacagtcactgaattactattaaatctggtttctgcacattattttatctaattcctacatctacctattaataggagttaaattcttttttatgcactgtagaaaatcaagtatagaagggtcaacaaaacaagatacacaagatggatataataagctactgcttacaaaaggaaagaatacaaatatgtgtcttgcgtggggtaggcattgcttatttgtttttaaagtaggaaaaattgaagtcaaaaatgtaaatggttttctattgaggacaaactagttccatacagaggagaacagatagctggattttgaaaagaagaatttagacttctctaaatttaattatttgtagatttgactctggaaccatataaacctttcaaataattttaaagccaagctaagtatataaaataatctataaaataatagcacagttaaataaataaacctatctttcaagctactggcatgactacatagaaagaagttatttcaaatgattttaagacatggtaatttgactgtacattctgagaatgaaaataatagaataaaaactattaaactctttttagtatttatattatagacggtagtgttagtactattattctgaaaaggttatgtgtgcaaagtgaaataaagtgaatgaataattatgatgtgttgctgggttcttggatttctcaccctggaagaaagctgtacagaactggggagattaaatggaaatccatgatcctgaatttgaatgggagtcaccagtatgaactcatgtcctattttttttttctttaaacaacaagaaagcttacattagctctgtctagagaagatcagtggaacacatgccacttttggtttctagcaaatgcttaataaatgcaagatattattctctcagttttgagttgtattgctaaaatatcttactgagaaagaggagctaaaattcaagcataactagctgctgtaaaaatatcacttatgcttgaactcttcgattaagagtactttaactcaaagtatattaatactaaacaaacagaaacaataatcttcatgaaaagaatgaattctccttcatccgtagcagtaggttctgggaccggacagtgaggtttatcaggaaatctaattttagccaataaaatttttacattctatatgtaggcattttctaagaactatgagcaagtagtcaacttatttttattttcgtcttctttttttttttttttaagacagggtctcactctgttgcccaggctggagtgcagtggcatgatctcggctcgctgcaaccttgacctcccaggctcaaggaactctcccacctcagcctcctgagtaaatgggtctacaggcatgtgccaccatggacatctaatttttgtattctttgtagagatggggtttcacgctattgcccaggctgatctcaaactcctcaactcaagtgatccattcacctcagcctcccaaagtgatgagattactggcgtaagccgacatgtctggccttactttcatctttaattctctttcgcattgtcaaatagaagtgatcatgcaaatttccaagtccaaatagagctcttcatgagagagaaagataattgcctaccagtaaggctgtccaaactagtttaatactattccttgtcagaccacaagatgagtatcaaataatcaccatgtcttaggatcacatctttcttgttctgattttcttttatcccgatctcattcttgctatctttattttctcatctcatctctgaaaccttaaactgaaactttccattgtctcactggaaatgacatagtgcatgaagccatgtacgagctacattgatagcttgattctcagttatttcagaagatttggctggattttgtttaaatcactagtcttcatgtttcttatggaactatgtttacttctcaccacagccaatgtggtgagaagttcattaaaatgtgttcaatgtctatttttgtggagaaagttttaaagtacttgccttaaacttttggaaagtatatcagcatttctgtgtgaatatacttgtgtgtgtatatatatatgtatatgaaggcacagtgtataggagacaggcagagggatgagtgcacattaaaaatatgtagacatgaattctagccttgatgccattcataactttgcaatgtagttttgggcaagcattgcatctcattgtcctccctttttaaatgcttactatgtggtaggagcagaatgggaacggttaacagaatgactaacatatactatttgcccttaaagaactcctaatctacatagtctactgacaaaataaactggtaaatccatagtcatggggaaaattagcacatatgcatctgtgccctgcattcataatataattcaaatacaataacaactcaatgacatgtgtactattactatttgcatattgtaaacaaaatgactaaaacatacattttaatgacttttccaaagtccactagttaataaatgcagtgattcaaagttaggactgtttgacaccagagggccacttttaaacatcatgccatactgcctcacttatccactacaatattatagcaatgatagaggtaacaaagagtgctagacttttctttttggttcctttggtccagaaactgaagagaatagttcttttagggaaaggtgaagtgacatttgaacttggcatgaaaatgtagattgccacttgaggaaggaattgataataagacttaggcaaagaaaagggaaaaggaagttcagagaaagatggtattactgtagctaggatttagaatattcaggctagtctggtgaacatgaagaaagaatcctagatataaggaaagaagtatcagattgggggaggattctaaagaatcatatatagtagtgcttctcaaattttaaagtgcatgagagttacttgaggtgttcattccaatgaaaattctgactagaaaagtctggggaaaagcctgatagtctgcatttctaacaagcacacaagtaatgatgctcatattttgagcatcaaaattatataccatacaaagaaacatggatttgttcaaatattgaatatgcaattgaatttttatgggcaagggaggaatatggtcaggtttctatttatttcaaaaataaacaataatttttgcatcactgctcagggtgactttcctaccttctatacagaaatgcatagggccaaataagatatactaggctttgaaattatttattgccaaaatatactagatattattagttaggatgttcacctttccttgatatataatcttttcaatatacactaaaagatagataggtcttcaatgattctaagtgaagtacaagatactaaattgattcacacccttgtataatatttttagttgccaataaacatgattggatgattttatgcattgatggaggtctactattggtttgccaaatgggacaaatttaagcttgtgaaggaaaagaagattgttgtgcctgccaaatggtttagacacagcaagcagagacttaaccactcagcagggtctccatccaatatctacgactgctgtgtgtgtgtatgtcctgcacttcaaagaagccagtttcgaacaagagcccttgagattcataatcagtaactcccacaggctttacagagatatgcaccatttggtttaaaggcatagcagtagcatagttgtaataggacagcatatttcttttccccaaagggtggtgagtcaaggaaatatatattaattattattagaatacatacaagacccctcatcaagatctaaaagggacttcaaaaatacatgactgctgccatttacaaattggtcacttgatgcacacaaaatatttgctccaaatcacagattttaacatggagggttgggtataaaagactgctctttacattcctaggaatttagcttccttgaggatagaagtaacactgtgatttctcctgtgatatgatttttaattccaaatgcttaatggatatttcctctttgatatctctctcttctgaactcacgttcccgtgctttcacgtcctgaatttaacttgttagacttctcattacacaaaaccaaacatgttctctttcttttatatcctttctctgattgcaacataaaacgcatcgagctgcccaaagccagaaaactcaaagtaagccctgacctacaaatgcatgaatctgatcctaattggcatacaaattagaaaattgagctaatgtgcatacctccacacagcttccaagctgaattctgggtgccacacatgggggaccgatctatgtagcagggcaaactttaaccattcagctaacatttaaacatagcccatgtagttgagttggacattctggtctcaaccaaaacatgacaactgcctgcaaaaatatcaacattatccacaggatttaaaaagaacccagagtctcataatataatattcaaaatgtctaggatataattcaaaattactcagcagaataaaaagaatcatgaaaatctcaacttacttacatgtcaaaagatgataaccaaccaatacatgccaatgacgaagtgatacagatgttggaattatctaataaagactttcaggcagctttttaagaaatgttgagcgagcaactttggaacaaacttacttagaatgtaatagcaaaaatataatataaagaaagctcaaatggcaagtcaccaactgaaaaatacaataaccaaaatagaaaattcactggaagaacacaatagcaaaataaagataataatctgtgaatgtgaagatacatcaataaacctgattgaatctgaacaaagaaaatactgattttaagaaataaacagaacatcaggaaactattgaataatatggtctaaaatttgtgtcattagggttccagaaagagagaaataaaaagagcatagttctaaaaaaaacttttgaagaaatgatggctgaaaacttactaattttggcaaatacataaacttataggtccaattggttcaggaactgtaaacagaatagccccaaagaaagtaatgcctagacatatcataataaatgtagtgaacacaaaaaacaacaaaatcttgaaagcatccagaaaaaatgacatgttaccaatgggaaaataatgattcaaataaccgtatatattttcatggagactagaaggaaatggcacaatattttgaaagtgttgaaagaaaataattgtcacctcataattctttatcctgaaaatatccttcaggacgaaagtgaaataacattctgagatggagtaaaactaaaataatttgtggctatcacacctattttaagagaattgccaaagaaaattaattatttagagaataaggaaaatataccagaaagacacttggaaaatcaggaataaagagcaacagaattaggaaatacctgggtaaatttaatagaccatttttctcttgagttctctaaaatacatttgacagttgaaagcaagatatttagcattagctgatggagttacagagatgtaacataagacaattacaggctcgtgacatcagcaaggtgaaatatgaagccttcatcttgtatccccacatagtaaccataatttaacagccatcatgggaaaaaagtgcctttgtaggagctttaggatccaggtaggaggttgcaaaaacccagtggagcccaagactgaggaaggtcattttgagaaggcaggaccaagcctaagtgacaggctttttgactatgtcctggaaacagacccagaaatagtcctgtcttcctgtggactctatggcttcatttggcattgatgcttccaccagtgcatgccactaaggggactgagacaagtcacacccattgtacctcagataacagaaggtcctgactgtggaccctgaggtggcccagtaatttggcttcaggtccaggaacagtcctgcctgtccagggagccccaaggggatctgactgcagatcctgaagcagccccctgtgattcagtattagccccttttagtcatggtccagggtcaatgctgcctgcccaggaaccttcccagtgaattggcaggaaccctcccagggatctggcagtagccacactatctgtacatgtgataacaggccggctatctgtgggctcaactgcacaccctgaagtgtgccaatcaagtgttacatatcatttctactgaccaaggtgcaaaaggcaggctggtccttccagaaataagacataattgacactcacccaagcccctggtcacaaccacagacccctctgcctgccctgcgatagccacataattagctgtaaccctatttgactacaatccctgcagtaatcccatcagcccagacactcaacatgagaaggcctttacttgccaaaagcaagctataaaatctggaagatgtgttatctcctccaaatgcaaaattgaaacaccaatgcaaggctacatggatcacaaagaaattggcaaaactgacactaccaaagaaaacaaagacccagtaaccaaccctaaagaaataaagatgtatgaatcgactaagaaataattcaaaataatcatcctacagaagctgagtgcaacacaagagacacagataaaaacaactaaaccaaatctagaaaacaatgaatgaacaaaatgagaaaattaataatgaaacagaaaccatagaaaggaaataaacagaaatctgtgagagggagaataccatgccagaactaaaaacatttaatggtgaacttcgacagcagactttaacatgctaaagaatgaatacacaaactcaaagacaggtcattgaaaatacccagttagagtaacaaaaagaaaaaaaaattaaaagcagtgaagaaagcacataggacctttgggatatcctcaaacaaatatatacattatgaaagttaaagaaagagaagagggagataaaggtaaggaaagcttattaaaaagaaaataataatggctgaaaacttctcaaatcttgaaaggaatagacacatccagatttttgaagctcaaaggactgcaagcaacattatcccaggacacattataatcaaattgtcaaaagacaaagaggaaattttgaaagcagcgagagcaaagcaattcattacacacaagggaacacccttaagtctacgagtggatttctctatagaaaccttgtaggtcaggagggactgagacgatattttcacagtgctgaaagaagagaaaatgcccgccaataataatgttggctttttgtataaaattgtgtttcagatctgaaggaaagataagtccattccctgaaaaacaaaaactaaggaagtttatcatcactagggctaccttacaaaaaacattaaaaggcagtcttcaaattgaatgaaaccaacaaatgctaaatgataacataaaaatatatgagagtataaaattcattggtaaagttaaatatgtagttaaattcagaatactttaatagcataatggtgggtcttatttttaaatccagtaaaaaacattaaaggcaaaattattaaaaataatagctacatgtgacactctgcatgtgtccccaaaacttcatatgttaaaatttaatcatctatgtgatagtgttaacaagctggactttttaggatagctctgccctcatgaatgaaattatggccgttataaaaagaggctgaagaaatgtgtgccccgttaaacatgtgagcacatatagaaggcaccatctatgagcaacaggccctcaccagacaccaaatatgctaccatcttaatcttgaaattcctagcctccataactgtgagcaataaatttctgttgcttataacttatcctgtgtaaggtattttgttatagcagcccaaagagactaagacactataataatttgttaatggagtctcttagtccatttgggctactatagcagaatattatcccatactgggtaatttatgaagaatagaaatttattgttcacagttttggagtctggaaagcccaagattgagattcctgcatttagtgaaggctgctctccactttcaggatagcatgttgtgtgtcctctggaggtgaggaacactgtttgctcacaaggcagaaggcagaagggcaaaaaggtgcaaactgactctgtaactctgtcaagttattttttacaagagcgcctaatccctaattcctcaatctcctaccaaagtccacaactcccgatactgacacatcaaggattgaattgcaacataaattttagaaggcaaaaaaaaaaaaaaccctcaagtaatagtattctgtcactgcccccacccccaaaactaattttcttctcacatacaaaatacattaattccatccaaatagccccaagtcttcactcattccagcactaaatttaaagtctattgtctcatctaaatcatatatgagtgaaactcaaggcacaatacatcctgaggcaaatttcccttcagctgcgagactgtgaaatcaaacaagtgcttccaaaatacaatggtgggacaggcagagggtaggcagtcccattccaaatgagaaatgggtaagaagaaaggaataataaattcctataagtccacaccgagcagggcaaacaatattaagccttgaagcttgagaatagccttgactacatctcaccttccagacacaactgggcagggattgggaccccaaagcccagggtagccttgtccctatagcttttctaggctcagcctataatgctcttattgtttggagctggatcgctgaagctctaccaggctgtcatggcatagcatgctggaggctttgaagttctggagtttcatgggcagctgtgtacccacaactccagtaagcactgttctagtgaaagctatctgtgaaagctccacccctgtgacagggttctgcagtggttccaaaactctccaagaaatcctttgggaacgtagctggaggaagccatgactccacaatttgtgcagtttatatgtctgcagaattagcaccatgtacaccaaggcttaccacctgttctcactggagcagcagcttgagcctcaccttagccacttgagtcacaactgaggtggccaaggagtgctgaattggaatgcaggaagcagagacctaaagcagcctcgagcagtcagacctggggtctcacaaaacagtcagaaaacaacaaaatggaaatagtaagtactcaccaatcaacaattaaatgtaaatggattaaattctcaatcaaaagttacaaagtggctgaatggataaaaagccaagatacaacaatattcttcctacaaaagactcactttagctttaagaacatacatagagtaaaagtgaggggatggaaaaaatattccctgcaaatgataaccaaaagagaccagtggtggctgcatttaaaacaattaaacctttaatcaaaaacttgtcacaaagacaaataaggtcactatataataaaggggtcattgtatccaccaagaggatacaatgatatacacacggaatggatacaatgatacacacacacacccacgcacacgcacacacacacatagacacacacacatagacacacacatattcaacactgaagcacctaaataaataaagcaaatactaatagaactgaagggagaaatagataacaacataagaatagtagggaacttccataccccactttccaacaacagataaatcatctagacagaaaatcaatgaggagatatggatgcaaataacattatagaccaaatggacctagaatacaggtacagaatattccatccaaaagcagatgaatatgcattcttctcaaaaacacataaatattctccaagatagattatatgttggaccataaaactggtctaacaaatttaagaaaattgaaatcatttcaagtatatttttcaaccacaaaggaatgaaactagaaatcaatagcaggatgaaaattggaaaatttacaaatatgtagagattaaaaactaaaccccttagcaacaaattcatcctaaaagaaatcaaagaggaaatctaaaagtacctcaagacaaataaaattggaattacaacataccaaaacttacaggatgcaacaaaagcagttctgagatggcagcttttagtgataaatatctactttatgaaaaaagaagaatctcaagctcacaacctaacttaacacctcagagaactggaaaaagaagaggagactaagcccaaaattagcagaaggaaggaaataataaagataagagcataaataaataaagacttgaaaggcaatagaaattatcaaaacagagttttctttttaaagataaacaaaattgacaaaactttatattgactaaccaagaaaaaaagagagcactcagataaataaaaatgtaaatgaaagaagcatttaaaactgataccacagaaataaagcatcataaaactatgagcaatcatatgcaaataaattggataaactagaatagatagacaaatttctagaagcataccacttactaagaataagtaatgaagaaatagaaaacatgaacagactaataattagtaagtatatcaataatcaaaaactttccaataaagaaaagcccaggacaagatagtgtcactggtgaattctaccaagcattaaaggagaactaatgccaatccttctcaaacttctcaaaccacacatagaattacagaaagtatttttctatgaacaaaatagtatgcaaagtcagacacatatgccttaagttctacagctatctccaagttcttctttcctccaggtttctgtaccattagatttttacaaaatttacaaataaagtcaatatctctagacaacaagagtaatttggaagtaaacaaaccagatgggatttaaatggaccccatctcataaaatcagaatgcacttctttctgaaaagtattcacaatataaacaattgttaagcaaaccagagaagaaataactgctagtagacagagaatgtaaaatggtagacaagtccatatcttcttaaatgagattgtataggatagaatctgggctctataattgaataactgaaattttgaacaagtttaactccttgagtctctattttctctaaaatgagaaaccatctaagattatgttcagaattaaataggtttatgtacataaatctgttagaacagtatctggctggaataagcattatgcaatgtttccttgtggtggtagtagtggcagtacttgttatagtagtaatatattgagtatgaggattacagttagccatccatacacagactcaaagccttgctcttctgtatactagtgtgaactcctcagaacattatagatccatttttaattttttaatttttttatataacaataatcatatctattgatactttgaaatgattaaatgagaaaataattataaatgcttggcatagagaaacctctaaatactgtttaccataatcatcaccattataattattattaattaacaagaacttgatgcctcaactaaaagacataattttcatctaaaatattagaaattagagaattaaaccaggatattgcaaagaatcacaaaataatttaatgtacttttctttaagaacagaaactgtattggtagaatattttctactgtcatgttgagaaaaacaaaataaattcaattttggctaatgaacttgaaaagtaaaatacacattatatgacacagtatctttaaaattttttaaatatttcttaattctgtgcaaaaaagcagaaacccatggacttgactgtctattcaaattcctgtgctgcagaggacttatgttactgaaagaattcaacctcagtagctgactttatctctaattcacaagaaattttattaggatcatggtacaatgtaaagaggattgtattgtaattagtaaccctgagttttagtattattttgtttttttttttttattgctgatctaaacttgagcaatttaactcttttaaactccagtttcctagtctaaaataacagtacctatgccataagcctgcatggaaaagaatagtatgatgacataagaaaaaataatgacagaagaaaactattatggtcgttattcagaatatatgcatttaggtatgcattcattcgctcatccattcaacccacactttaaggccttatttacaataaatttggaatcgcttatagaaattaaaactaaatatttttagttttacattaaattgggggaaatagaaatgtagatcagaaatataggttgagttggggagagatgaacaatacacaactgaagaagtcttaagagcttacataaatcgtgtagctgagtcatatattttactctgtttcctgaaagtcaaagtaaaaaagggaagcgtatttagctacatggttctaattagtcattccaaacaactgtgttattttcttttcttgcagttgctctaaaatcattttacttttttacagggcccatcaaaaaaggggtaggcacttagctacataggagataatgagcaatgggtcatcacctgacaggatacagcaggaaaacattttgtagtaactcttccagaaatctaccatctcactaaaatgcaaactattgaatgaagttatacaaggctccaaaactagatggcccaacattttccttttcactgatatagcttgatccaataactcatagattatctagagagatagaggatctacatgtttttaatataactccccacaactatcacctttccagtgaggctttcagtaacagttggactacagacactttgacgtgtactacctgagatgggcattaatgcctggagtacaaaaagtctgatttgttgtgtttggccaaattcagatgctgtagagttcaaaaagatatataggagtttagaaaatgctacaagattcctaatatgattatatataccttaaaataagtggcttaaaaacaggggataattttataacctacaaacaatataagcatcaaatttatccatgccttggaagtgtcatctactaggaaaccagagttcttacgatacagttgattacttgagagactgagtgaaaattatatgtgtgtatatatatatatatatatatgtgtgtatatatacacacacacacatatatacacacacattaccaataaatcactcaacaaagggatgtattattcttaaataataactattacttttctcttgattcctgtgccttcattaccttgccatgatcaaatactgcttcttgccctacaattgaaaataaaagagaacatctggtgatttagagaaaaaaaaatactgaagaagaacaaatgggaaaggcaagttagatttctgcttctcctatacgtatctgtatgactttggataagccgattacttgaattttactttcttcataaaaaattaggactttggattatattataccccaatttttttctagatttaacattccatgagttactaatcttttgaagagttaacataggttcacgagtaaggctgaggacaaaaggatgaagatatatttagaaggcatgatttgaaaacagagcatttaaaagacttactaaaaatcttagcaaagaagacagtttgagttttaaaaacattgtatggatgcaataatgaaattataagtaaacatcaaaatcatatccaagaattatgatatttataacctgatttatgtttaatgtcagtttaagacagctatttcaattgttttgaatgtagtgtttgatgaggtcaaggctgagttcagtctaaacaaaatccagttagttagttccaaaactagtaagtagatactcttgatttaagggcagccactgtggaagccacagcaggtactggacaaagtgtgaagaaaccaaggcaagttatttcaagtcaaaacaagtcagtctgtgactatgaatgccttcatgctagtgatattactgcctgtacattaaggaatatttaaggtataattaatatataatcaacatagaaaagactatgatagtttgcaaggacgtaatttcatatggaatatttgggcaaaacatactttgtgacagattgcaaaaaaaaaaaaaaaaaaaggccacaaattcttcccatttttaatgcatcccctttgcaatgtgacttagttgctcttccttataaagctgtggcatctttccctctacctttctatctgggcttgattatctgatttaggtttgcacattagcaaatctgaaattagagacttaaaaaggacctgtgcatcgaggcttgttccctgttgctgttttgggaccccagagccagaagatgaagaaccaatgctggcctggtagtgctgaagacatgtgcctggtttctctcattgccccaggcaaccacaactcatatcagtgaagtccttcagagcaggaccaaggagcacccagacaatcaagaataaagaatagaggaatcaaggacaagcacttaatatggcacaggctagatgagcagataatctgagaattgtaaaaacaaacacgctctattaaaatgtgtattaatcatcttaattcaattatgacttcattagtagcatatcttttaccaaagaaaaagaaagagttattgtacagactaagtaatcagcaaattaatcttaatgttttgttgtaattttggccacttaggcaagtcatttaatattcaaagcctcacctgctaacttatctcctggccacaaatcttgaccttgaaatcagaatctacaaagactaccagaaaggtccacttacaattaaatccgatcatgatcatcctcaggttaaaaaaaaagtctggttccttattgttgacaatataggtatgaatttttggttttagccttaacaagctttgattaggtaaaatattagttgccaatataaatgaaaaacaacaagcagaaactgagctgctgtatttgaataagaggtggggctagaaggcaactattttgttgatatctttggagaggttacaaaaggcatgatttgaacaaaaagaaaaggcaataaattaaatttcaagatctttaacatgccagtaggttttaagctcctctacagcctcatctctagcaactttttgtcttgcattttacatttcagtaatgccaaactacttgtagctcctgaaaggtagcatgtcacttcagacctccatttctctgcctttgctgtattgattcatccaactgaataatctttctctgttttagagtagttcctatttgttttttaaggtcaactttaggtgtattctcctaagaatctttccctaactctagatggcttacatgaatccctataaatctgagccagacctatgctttcaagttacctttttacatatatatccttaagagcaagggcgtgtgctaccgattcctagtctgtggaagattttatgtgatacataaatgtctgagactacaactctgagttagagcaaggcaagtattttaagtcaataaagtgacctgagaagtttggcggaataaaaattttatcacaaaatatctactgtccctgcttttgccaacctatcatttttaaaagtgcatgtatcttagagatgtattcttttaataaccaaatttattggtctataagggtccattgtgccactggaaggaggaataatttaaatattccttgatattttaatttgttttcatttaccagatctttctgaaaatattaaaataaagctggaatgacataaatagatgggagagggaattaaatggctgtgaggagaaaagtatatattccaaagatgaacaaatattatttgatattaacattcatttagaaataatctactggttatgcaatatatatcagaatgactataaaatggttaaatagttgaattttgcatacttgcaagcacaggtgactcaaatttatgttacacagacaatatcatggtaactatgtttcagcctgtgggatggagaagggaattttagaatttatgattcttgcaacagggagaatattataaaatccccccatatgtggccaagaacatagaatgtatgttcaagggcaccaaatgtaggatgtatgttcagagtatgctcaaatatttttcagttatataagagaaggagccgactttttttttctttctttctttttctagacagtctgactttgtcgtccaggctggagtgcagtggcacgatctcagctcactgcaatctttacttcctgggttcaaggggttattgtgcctcagcctccaggagctgggattacgggcactaccacgcctggataatttttgtatttttagcagagatgcagtttcaccatgttggccaagctgttctcaagcttctgacctcaagtgatctgcgtgcctcagcctcccaaagtgctgggattacagacgtgagccatggtgcccggccaaagctgacattttcaaagtacattttgaagaaagtagacttcactggtaaattaattctccgttaaatgaagacttggaattattgcagaatacagttttaagtagaaacaggaaccttgattgacatactgaactaattctccaactgcaaactgctatgatactggagtatcctgaaataaaatgaagagataccgcagaatttggataatacaattgtaatataaatctggaatgtattgaaacaaaatcagttctcctagctacatttaccaagggtttttaccaatttcttataaagaaaagtaggaaatttaaattttattgcattacatcatacatatatatggagtaatacaagaaaatgtatatgagtacatatgcgtgtgtgcgtgtgtgtgtgtatgtgtatatattgttttatatatgtacacacacacacacatacacatacatattttttgttttgttttgagacagggtctcactctgtcacccaggctggaatgctgtggcacgatcttggatcaccacaaactccgcttcccaggctcaaggattctcccacctcagcctcccaagtggctgggatcacaggcgcacatcaccacacctcgctaattttttttgtatttttggtagagacggggtttcgccatgttggccaggctggtcttgaactcctggcctcaagcaatcctcccacctcggcctcccaaagtgctgagattacaggcgtcagcaactgcacctggccatcttatatttatagatttctattaattgaatattgacctttatgcagttgtcattcaatattcctcatccacttattctctatcaattcctttgttgtttctataatgtcctaaattaaggaagctttttaatagagagcagtggttctctgattgcatgttggcatcagctggggagggtttaaaaattaccaatgcccgtgccagaattctaatttaattcatctggggtggggactatacagctgatatatttttgtaaatgctcccagtgatggtaatgtgtatacatggttccactgttataaaggtattctcggacaagaaagccttaatacgagtcttagagtaaacagaacacaaaaaattatagcattaggccttaaagtgtcttatttttatccatatgctttttaagtttcagttatgtttgataacttccaagacattaaatctttggttatatatagaacacctcagattcaactagctatgtttcttctacaacagagattgtacatgagccaggatgagacaaagaaaatttgtcattaaagagtttagtaggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtagcgggcccctgtagtcccagctactcgggaggctgagacaggagaatggcgtgaacctgggaggcggagcttgcagtgagtcgagatcgcgccactgcactccagcctgggcgacagagcgagactccgtctcaaaaaaaaaaaaaaaaaaaaaagagtttagtatttacaggaaaaacaacagagctaaattatattagtggggagggtaaaaataaagattttcacggaatcagttctcacttgaataacaagagaggcaggatattggaatggagggttaaaatatatggaagaatctaagtaacataacaatgataagaaaacgagacgattaataaatatcagaacaaattcaaccttaatcacaaacatacttaaagttcactgtaatgcagagttaggtgtagcttaatgtctgatttaataccgcagatgtaaatctcaggctcacagaaaacacagatgattctccttgaaaaacccactggactttcttgtacctctttaaaaattaacattccaattgtagatctaaaataatctatgtgttagaacatgttagatattcatgtttatttaaacttcaagacttccacatggtggcagtaagtagctgttctgttcaagggaaagaactggcacctgctctgtatctccatgcactgaaaatctctactataatgtgctagggaattctgaatcattgtaaaaaaacccatctttaagttgccctctgagacccatgtattggaacacacatgttacaactccgatgatatggcaagaccaagaacatctggcatccacactgaggaaagacatcaagactcgtgggctttctggctctgccaacctttccagtagtgttacttgcaaattccatgaatagcacagtacaataattacagtgccttgccttatctttatgcctcttgttttctccaggtcaagaacatcttttattcctttcttcacataactaaattctgctcttcatttaggatgactgcaaggaatctattaatatttctttctcttttgatggcaaaaactgcaattacttttgcatcaatctaatatttcagtcaggtattcttcatatgactgtccacctgatcatacacttaacactaccctaattctttttacccaatattttaataattttattctctgttatactacactagattgactaagatccttcatctcagaaatgtctcatcacccatcacagttttgactcaaaactgcccaatttaccagacttaatttacatttggttttccctataatatagtttaacagcatacaacgattgctttcattatgacatttctaacaattataattttatgatttttatgtcatcacttctttactgtctctctacaggcagaatctagcctttgttatggggaacaccatatctgttttattctttgttctattattaacccctatcacagtttctaaaacatagtaaacataagtttgctatatttcagacatttacttttgaaaaataattcaatgaatgaataaataagaaaatatgaattaagggatcaataggcaatataaagttgaaatgattatctgacaattcaataaaataattataaactacttcaagtaattgataaggtttatttcagaatcagctagaccattcttttctgcctcttacactttaattatcttttattaagtacatccatcatgattttcttggatccctagggaatttacaagtccctgaagatcgtgcctatttttagtgaaatacaagtgatcaacagtttgtttaattagttttgtctgggcctgatcctatcatatctaaaattcagttcactgccttcaacaaaaggttacttaaacatgaaaatagataaattgacagtcattttatgtagatatctacattcttatcttcacttggataagcagaatacatatgctacatttcttgatgctatgaattgcatgtttgtgtcatcttcaaaattcaaatttaaacttaatccccagtgcaacgtgttaagatatggtggatttaggaggtgattaggttatgagggctcaactttcatggatgggattagcactcttacaaacaggcttgagagaatgagttcaggcccttctgcccctctgccttctaccatgtgaggacatagcatatttcccttctgccatgtgaggacacagctaaaaggcacccttttgcaaggcacaaggcctcccagctgaaaggccttcaccagaaactgaatctgccagaactgtgaccatggactttcatccttcaaaactcatagtttctgttgtttataagctacccagtctcaagtatttcgtatggttgtataaacagactaagacagaaattagtactgagaagtggtgtgtttctcgggctggggtagctatctcaggctggcgttgctagaggagaaaaaaaaaaaaagagagagagagggagagagagaagtggcatgcttctgtaacaaataccatttggaagtgactctggaactgggtaatggatagaggctgtaccctaaagtgctattctggtgacggcttagaagagaaggagaagtgtagagaaagcttgaatcttcatagagattacttaagtggtcatgattataatgttggtagaaatatggacatgagagctagttctggtaaggtctacagtggaaatgaaaaacaatgtattagaaactgaaagaaaggctacccttgttataaaatggcaaggaattcagctgaattatgtctgtgtcctagtgctttgtggaagacagaacctgcagcaatgagctaggatatttgatggaagaaatatctaagcaaaatgtggaaggagctgcatggctaatcttggctgcttatagcaaaatgtagcaagagagaaataatttaaagatggaatttataattaaaaaaaaaagttaaagatttgaagaagtatcagcctgtccagattgtaaaaaattaaaaagtgtgttagggagaagacactaacggtgtggccaagtgaacatttgataatgacattagtatgaatagaaggaagccagatactatttagtaagacaatgaaagaatgaccctaaaggcatttcagatatctttgaggctgtcattctcatcacagacccagagtgccaggcccttgagggcaggatggttttatgagagaggctcatgttgcccatgggacctcagaggtcactgcctagcatcgcctcaaggttctgctccatacattctggcacagcactccttggcctctccagctgtagcttagatggccccaggtggtaaaccttggagacgtccatgtgctgctaactctgcatgcacacagagtgtatgaactatgaaagcatggctgcctccaccttgattttaaaagatgccttgaagagccttggggaccaggcagacaaatgccacagaaagctcccagtaaggtgacaccatggggctaagaccactgaagagggtctccacaagagaaaagccttttggagatgtgcaggtgaggctacctcaaagaacccacaattatagagccaccagcatgcaatgccagcctagaagagcccacatctacccaactccaatccatgagagcggctgttgtgctatgcttagaaaagcagtgaaggtaaccccccaacaaccccatggccttggggactcaacccctaccccaacatattcagggagtgggatatggatttaaagaagattatttttaagcctgaagatttaatgttatttgccttgtttggttttgaacttacttggaacctgtttctcctttctttcttatttttccctttagaataggaatgcttatcctatgcctatctcacactgtatttgggaagcacaaaacttacttataggttcacaactggggaagaatttgcctcaggataaatcatacattgagactcacctgtatcagatttagatgatatttagatgagattttaatttttttagctgatgctgtaaagagttaagatttgggggactattacaatgaaatgtatatattctgtatgtgagaaagacatgaatttgaggggccatgggcagaaaatgtactgagtcagatgaaggaaagttaggaggaatttggaaggaatgtgagtgatggtgacatagctatgacagcattctctcccacttccaccctgctgaaaagtataataatcagactcagttcaaaagaaattgtgagaaaccaacattgcaattcctagacaacaagtcatctgattaggggttggggggaaggtttgaaggagcaagttgagaactttcaaactctgatatcatgagccagatgatccctagaacagcctagagaaaggaaagaagaaagcaagtaagagggctagcatatacatagggcttccacacagatgaaagaacacagatttgcaattggaaaaacttcaaatttcactgttttattgtttgtgcaagtttagaaaaaaaaaatcctccaggtcccaactttctctttgataatctaagaataatagcattacccagtgtttttgtgaatatagtatgaacgtagcgggactttgatcaaagtattccatttcctttctcttccatataaggtaaaagccatagctttgagtttgttagtattcactccaaaactgaactgaatatacagactacattagttttccataattacctgtgactgactttcattgagaaagcatatttactagatgtttaaatagtaagtagattctttggcagcctggtgggatcttgtatgagtgctggcaataataacatatgcctatttctctcaaagcatattgatggtgttttaaaataccaggaatctattgttgtaacacctcaactgaatattgcaacaggttaggcttttcactgagaacttatcctgagcacatgcattacctatttcggaaacaaagaaacctgtgatgctgcattccatatcacagttgttgatatacagcttcttacacaaagtgctctagatggaagccaattgaggttaagaatgtaggacactcaacgtaatctgtagaaaagaagcttttacaataaaggcagagtagctgatcttaacactaaaaaaagatggaaagaataatgaaggacaaagtgagaaggcagaattcaatacaccctctccactctaacagagaaagcagctacagtaaaatacttccatgtctggtactttaaacttaatacaatattttttctcagtttacaaaatatttcttataacttacatattcttcaacaaatcagaatgatctcaaaatgaaataagttgtttaagagggaatatagcagcaaccaaactattaaactaccttgtaagcctgtattttgtggtgataatcatattaaaattccaaggatttgctggggaattaatgtttaaatgtttttaaaagtaagcccccattcctggttatacattccatctctatagctctgagtttcttagacatcctacaacttagtaacacaggtgattctaatgtaaagtcaactcttggacatctctgatttagtttgttttatcattttcaattatcatagaggaaacatttggaaaaaataattaaattgattagagaatagaagtctcaggctattgttcatgtccttggaagtaaacttgagtatatagggctagctgtgggaaactatgtaggcaacaagtcaaattaaaatcatgtgattggagaatgggaggaagtctgaagtcaaatttgcactctttagaattttgcccacaatatattgtaagacaaacaacaacaacaaaacaacaataggcaaatgagaaaactcaagttatttaagctcaaatatacaaatgccacttacatgaacacgtgaatcatttcacggttttacgtcctgatatttccacttgcattcactcttcctatatctatggttactgccatatttcagacccatgatacattttacctgtgctgctgaagtattcaaattgattctcattgttttcattctccccatctctattctattctccacagtgaatccaaaatgactgttcccatacatccaatctgccatcttcaaattcctatgcctatcatacgactatgtgttctgacctctgcttatctcttgactatgcctcttgtcatagtcacatgtacactccacacttactgaatatgtacagttttcagaacacacctgatgtagattatgtttttaaccccagtgccgccacattcatgctacttcctctttcgggcctttcgctaccatctgtaccttccctacctatggtctagtttacctttatttttatgaatggaagcagctataagatacccagagagtttaggagagtcttgttgtaataaaggtattcactgagttctatttgctcaaggaaaagcacactttagagatgctctttttgagtcattatggtatcaagttggtattgttattgcatgaatcaatgaagaatagtctgataatggaaacactcaatggggatatttgcataaatgctctgttttgttatattgatgtgaaaaattctgatcctctttcattaaggtgatttttgtagagcattgtgaatcacacacgcacacacacacacacacacacacacacacacacacaaatccatttccatctacattcaaattttactgcatctcaagagcctaggaaattttagtgtgggaaaagagctgtagagaaccagagctagtagctgttgcaattacaaaatgatcagaacatgtctacattatcaatctaacttaccctctgccactccattttggggttaaaatagaatttaaagagtctgaatattttgacatgatagagggttaatctttcaggaaataaaatttgaaaacctgttcaatgtcttcacgatgtcatagaaacacagaataaaagaagcaacatatttgtagggtagatgcttagttttgaacactaacttcaaatcagacacttagaagttatacgatattttaacaaacaatttaatttccctgaactttattttctgcatctgtatgtaataaaatttacttcaccaagttagctagaaagtcaatgagagagcataaaggaatgcattttgtatactataaaactgaagagattgcacattaatcactaagagattatgttaatataaaattcataattatcacacattgtaagataattttataattaatatgaccatgaccaattattatcatattctgggctgtgattcttgcattttcaatcacgaaaaatcaattacgataatatcaaaaattattgtggataaactcctgtaatatcattgataaagaaaaagcataatggcagacagtattaggatagtgcaaacataactgtggttttttgcattgttgagatttgctgtttgatattggaatacattcttaaatgaatgtaggttatacatcatttaactgttcatttctcaatttataattttttttgctaatgacttcttgttatttattttatatttatttagactatggaaatgatgttagacaaaaagcaaatttgagcaattttgttattcgggttcaaaatgggtcgtaaagcagcagagacaactctcaaaacatcagcaacacatttggcgcgggaactgctaatgaacgtacagtggagtggtggttcaagaagttttgcgaaggaaacgagaggcttgaagacgaagagtgtagtggccagccattggaagtagacaacgacaaattgagagcaatcattgaagctgatcctcttacaactacaggagaagttgccaaggaactcaccatcaatcattctatagtagtttggcatttgaagcagatcggaaaggtgaaaaagcttgataagtgaatgcctcatgaacagagcaaaaattttaaaacattgttgttttgaagtgacgtcttctcttattttacacaacaatgaaccatttctggatcgaattatgacatgtgatgaaaagtggattttatatgacaagctgcaaaaaccagctcagtggttggatggagaagaagcttcaaagcacttcccaaagctgaacttgcaccaacaaaagctcatggtcacaatttggtggtctgccgccagcctgatctactacagctttcggaatcccagcgaaaccattatgtctgagaaatatgctcagcaaatcgatgagatgtgccaaaaacttcaaggcctgcagccggcattggtcaaccaaaaggatccaattcttctctaccacaacgcctgaccacatgtcacataaccaacccttcaaaagttgaataaattggtctacaaaattgccttatctgccatattcacctgacctctcaccaaccaactaccacttcttcaggtatttcgacaattttttgcagggaaattgtttctacaaccagcaggatgcagaaaatgctttccaagagttcactgaatcccaaaacatggatttttatgccatgggagtaagcaaacttatttcttgttggcaaaaatgtgttgattgtaatggtgtctattttgattaatatagatgtgtttgagcctagctataacaatttaaaattcacaatccaaaaccacaattatttttgtatcaacctaatactatagatttaacaatattaaattacaaagccttttaattcaaaataacaggcatatgtcttttgggtgaacagtaaaacagtatatatatatatatatatatatatatatatatatatatatatatatacacacacacacacacatatataaaacatatatactgaccatacgtatacacacgtgtgagtgtgtgtttgtgtaaactccatgcttgatggacggatggaatagatctgtgagcaacaaaaccacagttactcaggaattcttgacttaaaagtcagcagcatcagtgctagatgaatgccatatatacatgaatagaatccaaaaacctatcagcctaactccaaattttaataacttcctcagtgtcctcccagcacttagtaatagggccagtattgtttaaatactatcattttttcatcgattatttaagtttcttgtctgttcacagatacagtatttgaagattccaaattcctcaataaaattaaattgtttattttcattagcaaagcaaagttctgacaaaatatttgatgccttatttgaggtgttaggaaaacgactggaattagatcaatggtgttttttataaagcaaaacctgctataaatatagattagatttgcaaccagatttcattaacttatcaaaggagcagtgggtcagcaatttcgagacattttccttcagaactcttgtcacattccagaatttctcagaatgattttggtatttatatgggaatttcgaaagaaacttcaaaagaaagtatgtgactaattctacatgcctgcattttgttacctaaattctggagagggacatgtaatgtcagatgacgacatctctaccctccttgccacctaggtacaaaacctcagtcatccctatacattcttctctttcttacttttcaaccacttgacatctaagtatatatgtatggttgttatccctaaaataatagccaaagttgtcctgcattgaatttgtaaaccaatctgagaataactgaaatctttataaagtcttccaatccatgaagatgatttattcctccatatatttgagttcttttaaatatcattcataaagtttgttgttttacaggtttattccatggtacttggtattttattttgcacatttttgtgatgctgctatattttgcctgcaactaaccaatggaaattacttaaaatccttcaccaaacctttcacttaggcattgatagcacccatcagatggacaaattattatttgttggaccaggccttttcaaaactatcaagcagatagtcaggtcctgtgaagtgtgccaaagaaataatcccctgtatgcaggccatacatttcaatctctgtatctttaacctccttgttaagtttgtctcttccagaatcaaagctataaaactacaaatggttctccaaatggagccccagatgcagtccatgactaagatctactgcggacctctggaccggcctgctagcccagctcccacattaatgacatcaaaggcacccctcccgaggaaatctcaactgcatgacacctactacgccccaattcagcaggaagcagttagagtggtcgttggccaacctccccaacagcacttgggttttctgttgagatgggggactgagagacaggactagctggatttcctaggccaactaagaatccctaagcctagctgggaaggtgactacacccacctttaaccactaggcttgcaacttagctcacacccgaccaatcaggtagtaaagagagcttgctaaaatgctaattaggcaaaaacaggaggtaaagaaatagccagtcatctatcgcctgacagcacaaggggcgggacaatgatcaggatataaactcaggcattcaagccagcaatggctacccactttgggtcccctcccattttatgggagctctgttttcactctattaaatctttcaactaccaaaaaaaaaaaaaaagaaaagaaaaacaattaacttttttatatatcagttaaattcatccatgatgttttttatgttttctgtattcttactggtcatttttctatttgttctatcaagtatccaggaatatgtgttaaagatgtccacttcaattgtgaatttcttgagttgttctttcagttttgttctttttttaccttatgcattttgaagttgtattatttcctgcatacaaatgtagaattgtggtgtcattcttttggagtaaaccatgatcattactggcatgacttacttacttactatctatctagacatgttgattgcttcaatttctactttaatcttaataaaaatacaccaactttttaaaaagtattacgtcttgtatttctttctgtttgactttattattacatatgcttttttctcttcatttgccagagtctttgattgatcaacaagctgttttaatctaccattttttatctctaacattttatgtagagcttctcttactttttagttattcaaaagatgcatctttcaattattctagtcttaaacgtaaagatgacttttttcatttactgacaatgtcagtaatccaaaacttttctatttaactccttctaccttttatgttattgttgtcctgaatttcattctacatgagttgaaacctcataagggattgttgttgtttttatgcaaacatttacttatatttacccacatatgtacagttttcttattgctctctatgcattcttacaattttctacttttatatctgtcatcatttccttctctctattagtatttctttttattcatatattttagcaaaacgttttctcagtatttgttgtccaaagtgtcttacatggtttttttttatgatgttcagaaactgagattactcaacatttggctacatttcgggggtaagagtctgaattggattcaccctgcttccacagtgtagtcttctaggtatccgactgaaaatcagtagttgctcttgactcttttgtaaatgaacgaaaatacacacacacacacacacacacacacacacacacacacacacaaatgttataagatttttggaagtttttcccagataggtagttaaataataaacataatttaaattgtttagaacaaaacatagctcaaatgatttatagtatttatggtattaccatattaaaatgtgtgaaattgtatatctttattgaaaatttaattgtacatatttattgaaagctaaagcttctaataaaaaagaatagaaaatcccaaaaagaaaatattatttctaagtgcaattatataaaacaatagaatacagatatattaaataaagatactatctgtatatcttaattttatttactattttaatctattttatgacttcctattgccctatggaaaattttctcaattttaatatgtcattaatttattatttactccaaacgtttatcaatcctgctgttttccatatatgcttgattttcaagatattgatttctttctttagatagcaacttttttcacacttgacattttcactaaatgaaaatttctgttatttgtatgatttctattcttgctttatatgaataatagcttctttatctaattaaatatgtttatcctgcctattttatattattgccccacctgttccacaaatatggtggtatatgagggtataaaatgttatataataattaatcttttaaaataataaataatcttttaaaataataatatttgaactcctcagatacgtagctattttggcttgtttaggtctatttgaactattcagatgtatagctattttggcttgtttgggtcatagtccccaatgctatgagcgactttgttcgataatatctataaaggaatggctgatggcaaaaccccagtctgtctcagtcttggtgagttcaaggagatgagagagattaatccttaaagtagataaactgaagcacaataaactaaatattaataatagcagtttgcttttctttcatcagtttcatctttaaactcatggagaagaagtaccaaaaagtggcaatactgtcagactttaactatcaatcttgaggagccagatgtacgaaacacagagggaaatgattgagtaaatacttgtcagtcatgttcagcctttacctttctcattaactttcaactccacctttgaaatcaaccacacagatgccaaccaacttgactgttggtgtcaatagattaaattacagggtataataatccaacggcagtgcaggggaaagattagagaaaaagaattttcctttaacatttttctctcattaacgcctctggctttccctgacacctccaatcactcacctatccatggatccatcacagttgtattttgggaattaaggaggtctggtatccataaatacttttgattttatagtttctaaagggatgtcaagaaatgttgtcaacaatgtgtaatacatcactatattacttgaattacttgaatttatttccataatttttatatttgtattgttactaagtattttttgaatcattcactataattttataaaaataaaataatgcactacatattctttttggtctgactcttcactcagcttagttattttgaggttttccgtgtgtgtgtgtgtgtgtgtgtgtgtgtgcgcgcgtgtgcgcacacatgcgcgtttagtagaaatgggggattcaccatgttggccaggctggtctcgaacttctggcctcaagtgatctgtctgcctcggcctcccaaagtgctgggattccaggcatgagccaccacacccagcctattttgagttttattctcattgttaaacatatctataacccactctttgtgattgccaagtagtagttcgtggtgtagatatatcacaatttgtttattgtgataaagttgacattttagttttcctcatttttttggctattacaaataaagcttagataaacatttgcttctaagtctttgtttggatatatctacttaatttcccttgtgcaaatatctagaagtagaatggccacctcataagataggtacttgtttacttttttaaagaaactttcaaaatattttccaaagtaacatctaacattcacatcagctgtggatgagagttgtagtttacatacctcctgaccaacacttgatatagtcagtcttttatatttcacatattctaaccagtgtgtgtagtaatttcttatcaatataaaggggagtttatatattatatatataaaatacaaaggggaatatatatagtatataatatatatgggaatatatatatgtatatataggagtttattaagtattaatttaaatgatcacagggtcctgcagtaggacctgtctgcaagctgaggggcaagcagagacagtccgagtcccaaaactgaagaacttagagtctagtgttcgagggcaggaagcatccagcatgggagaaagatgtagactgggaggctaggcctgtctcacctcttcacgtttttctgccttccttttatttgctggaagatgattagatggtgcccgtcaagattaagggtgggtctgccctccctagcccaccaattcaaatgttaatctcctttggccacaccctcacagatatacctaggattaatactttgtatccttcaatccaatcaaacggacattcagcattaaccatcacaccaagtatgggcatagtttcaaaaattcctcattatcgatttccagttttaatccattatggtgagaaaatatgcttaatattattttattattttaatgttttaaaactcactttgtgatctaacatattgtctatccttgagaatgagccatgtgctgaggggaagaatgtgtattctgaagccatatgataaaatgttctgtaaatatctattccttctgtttgtcctacagtgcagattatgtccaatgtttctttgttgattttatgtctagaaaatatgtccaatccataaagtggggcaatgaagtctccagctactattgtaatgaagtctctatctctctttgcctctgttatttgctttatatatgtgggtacgccagtgttgggtgcctatattaatttaaaattgctatatccttttgctgaattgacccctttaacattagtgaatttctttgtctcttcttacagtttttgtcttatagttttgtcttaaaacctgttttgtctgatgtaagtacagctactcctgctattttttggttcctattggtaagggatatctttttcatttcttcattttcaatctatgtgcgtctttataggtaagatatgtttcctgtaggcaacagatgactgggtctttttaaaaatccgttatgccactctatgtcttttgattggagaaattatttcatttacattcaatgtcattattgataagtaaggacttaattctgccattttgttatttattctctggtttgttgttttgtgatcttctcttccttctttccttccttcctgtcttccttttagtgaaggttattttctatggtggtataaattaatttcttgttttttatcttttgtaaatctattttatgttttttaattttttattagttgagtgaccttatttgaggtgaggaattgaaaatgaatgctggtggtgggaggaaatgatagaacttgagattacttaggattaagtgaactgggttcaagtcgcaatcctgctactagatgagaaagttacatcaaggagggatttttttgtttttgttttttcttttctctgtcatcttcatttcctctgctgttaaattaaggaatcattctgggtaatctctacaactccatccaggcctataattctgtgccgagcgccatgcatgggtaggcttgctcaatatttatttgtagaatatacacaattttaaatcacaaaagaaaatcctgacataaagaagtaaatctgtttgcttctttctacaattggtacctttcgacaacagagtgactcttttaatttccaaagtaatagccatttatagaccaagaagtgaaattaatcaacaagcagatggtttggcacatcctctcctttcctggtactcaacttattttaactgcagtgaagtcttatttgcttagggactaggagatcgaccttaagcatcccaactacctattgggtcaaggccacttaaagggcagatgacagccaaggtaaacaattcaatactcctcaagcatattttttatttgaagtattagcctgatttcttgttttctttccaatggactttcacgtaatctgattctgattactagttgatgagagaatattgaggtttgacttttgttcctcaatcttgctcctgactgtccaatctactgttgtaaagcatgccatttcacgttcttgaaattttattctcttctatttgcaaaatgagtggcacttctctagtccccaagaatgattcattcatcctggtgtgtggactctcacattattatttactatctgctgtgaaaagcacacaaagttcttggcaaagctggagttgcaggagtcctatcagcaggttgaaagagggagacttgatgactgtgcccaagacatgctcaggttctcactccttctctggtaatgtctttgttatgaccctgatttttggttcttatgatagtgttttttctgtgtagatagttgttaacttagtgtccttgcaagaggaataattggtggagttttctattccaccatgttgttctgccactctggccaggtgacaatttaggacctctaaaattccactaaaaatgtattccttctgatactcctattgtatgttttttgattgaagttaccacatggcttgcaattactgtcttataacctgttattttaaactgatggcaactcaaccctaattgcataaacaaacaagcaagcaaaaagaaaactaataaaaactctacactttaacattgtccctctacgttttaactttttgttgtttctatttatatatttttgaactgtctatgtcttgaaaagctgttctagttattattttcaatgggttcatcttttagtctttccacttaagattagattagtttacacgccacaaataacattgttattatagcctgagtttttttgggtacttactattactagtgagttttgtacctttagattattttgtattgctcattaacctccttttctttctgattgcaaaaccccatttagcatttattgtaggacaggtctggcattaatgaaatccctcagcttttgtttgtctgggaatgtctttctcttccatatctgaaagttattgttccagatatactattctagaataaaaatatttttcctttagcactttaaatatgttattccactctctcctggcctgtaaggttttcactgaaaagtctactgccatatgtattggaacttcattgtatgttatttatttcttttttcttgctgtttttaggattcttttttttaatcctttacatttggaaattttattattgaatgccttgaggtagttgaggttattaatactgagcgtcagcttagtatccaatccaactgattggattgaaggatgcaaagtattcatcctggatgaatacattcatcctggatgtgtctgtgagggtattgccaaaggagattaacatttgagtcagtgggcttggaaaggcagacctttcctcagtctggatgtacaccatctaataagctatcagcaaatgtaaagcaggcagaaaaatgtgataaggttagactgccttagcctcccagcctacatctttctcctgtgctggattgcttcctaccctcaaacatcagactctaagttcttcagccttggaactcggattggcttccttgctcctcagcttgcagacagcctactgtgggacctcgttattgtgtgagttaatacatgtatatatatatacatatatatatatatatatatatatatattctgttcctcttgagaaccctgactaatacagattttggtaacaggagtgattctagaggaagagaatattaagaatggagttctttcattgattttggggtttctggagttggatgcttaatatgattagatccaaaaatgctgagcattctacttctaatagtatggagaacactgatagtccttggcatgaactgtttagagagttatgcaaaatgaattcatttgatactcccgattcaccactcatgagaggcaaggagtttagtgactctatacaaaagacatttgactacatgagtagaaccaaggaacataaaaagttggttgattgctcctaagttcactggacaaagtgatgaaagaaaatgatgagctcagagattctaactcccagtttagaagcagatactgtctcaaatctgctaagattgccatgagtaagagtcttatctcctgcagagaaagagctgtaattgtggaaaaacagacacaagctcttatcatgcaagtggctgacctgcaataaaaggtgcatgcacagccttaccaggtggctactgttaaagtgagggcattgactggaaaagaatgaaagcttgcaacttggaaggggatatgtgggaggaccctgatgaagctggggacaacgagttcgtaaactctgattaacttttcttgccagaagaaacagctttcctatccccagtagtggcaacatcccctccccgacccacactcctatcagcctttccacctttgtcctaggagataaaccctgagctgcctgaggcaacagtgatggcctcctctgaggcagtttccaggcaacataatgttgattctcctcaggatccactcccaatacccctttttacttctagacctataagtagactaaagtcctggtgggctcctagacgtgaggttgagagtgtgacctatgaggaggtatgctacactcgtaaagaactgcttttgttttctaatttatataagcaaaaaatctggagaacaggtatgggaatggatattaagggtatggaataatggtggaaggaacacagatttggattaggctgaatttattgatttgggcccactaaatagggattctgcatttaacgttgcagcttgatgagttaaaacaggttgtaatagtttattttcttggttggctgagataaggattaaaagatggtccactgtgagtgagctggaaatgcctgatctcccttggtttaatgtagagaaagggatccaaaggcttgggaaaatagggatggtggagtggattagttactttatacctaccatcccagctgggagagtccagaaaatatacccttgacctatgctttgcaaaatagatttgtgagggcagcacctgcatctttaaagaaccctgtaattgctcttctctgtatgtcagatctaatggtgggaactgcagtcactcaactacaaaacttgaagacaatgagaataattggatccctgaggtggcagggaccaagtggcagcactcaactgtcaaagggaaggtgggtgtagctactgtaatggatagtagaggcgaagcagcaatcagaatagtctgactcaggtagagctctggcattggctaattaagcacagtgtttctagaagtgaaattgagaggaagcctactgcattcctacttaatttatataagcagaaaacttccagatcaaatggacaaaagaataatttgaattaaaaaaacagattattgactgtgtgcagtggctcacacctgtaatcccagtactttaggaggccaaggtgggtggatcacctgaggtcaggagtttgagaccagcctgaccaacatggcgaaaccgtgtctctactgaaaatacaaaaattaactgggtgtggtagtgaacagcagtcccagctactcaggaggctgagacaggaggactgcttgaatccgggagacggaggttgcagtgagctgagatcacgccactgcactccaggctgggtgacagagcgagactccacctctaaacaaaacaaaacaaaacaaaagcaaaaaataaaaaataaataaataaataaataaaaaacagagaattggggcccctcagtcaatttccagacttgattcagtttacagactcagaattccttgaatgaaggggaggctgggtccccctgaggaaggaccccattacactaccaaaaatttatgctgttaatctttctcccgtccttccacaaggagatctctcgccttttacaagggtaactctgcattgggaaatgggaaatgatcagacatttcaggggctactggacactggctccaagctgacactgattccaggggacccaaaacgtcattgtggtcctccagttaaagtaggggcttatggaggtcaggaaattaatggaggtttagctcagatccgacttacagtgggtctagtgggtccctggactcatcctataatcatttccccagtgccagatgcataattggcatagacatacttagcagctggcagaacccccacattggctccctgtctggtaaggtgagggctattatggttggaaaggccaaatggaagccactagagatgcctctacctagaaaaatggtaaatcaaaaacaacattgtatctctggagggattgcagagattagtgccacaatcaaggacttgaaagatgcaggggtgatgattcccagcacatcaccgttcacctctcccatttgactttgcagaagacagatggatcttggagaatgacagtggattatcataagcttaaccaagtgttggctccaattgcaggtgctgtaccagatgtgatttcattgcttgagcaaattaacacatccttggtacctggtatgcagccattggcttggcaaatacctttgtctccattcctgtccacaaggcccagcagaagcaacttgccttcagctggcaaggccagcaatacacctttactctcctacatcaggggtatatcaactctccgcttttgtgtcattagctgatttggagagaccttgattggttttcacttccacaagatattacactgattacagtatgctgattggatccagtgagcaagaagtatcaaacacaccagatttatttggtgagacatctgtgtgctaggggacgggaaataaatctgagtaaaattcagggaccctttactccgtagaatgtctaggggttcagtagtgtggggcctgttgagatattccttctaaggttaaggatagttgctgcatttggcccctcctataaccaggaaagaggtacaacgcctagtgagtcttttggattttggaggcaccacattccacatttgggtgtgttactctggcccatttatccagtgacccaaaaggctgccagttttgagtgggtccagaacaggagaaggctctgcaacagttccagggtgctgtgcaagctgctatgccacataggccgtatgacccagcagatccaatggtgcttgaggtggcagtggcagataggcatgttgttcggagcctttggcaggcccccataggtgaatcacagcagaggcctctaggattttggagcaaggtcctgccatcttctgcaggtaactactctccttttgagagactgccctttgcctgttactgggctttgttgcatatagatatatattcatttatatatctatatctatatctatatccatatctatatctatatctgtatctatgtacatatcctattgattttgtccctctagagaaccctaatactctgtcttctttgagttaaatatgcttggtgtcctataatctttttgtacttaaatattgatatattttcctaaatttcagaagttttcttttattattcctttaaatagataatctatccctatctctttctctacctcctttttaagatgactaactcctagatttggtcttttgaggctattttttataggtatgcttattctttttttattatagttttcttttttctcccctgatcaagtatttgcaaattccctatcttcaagctcactaatttttttttttttttgcttatttctgctattaagagactgtgatgcattcttcagtatataaattactttttttgaagcccagtatttctactttattttaatcatttcaatctctgttaaatttatctgataaaattctgaattccttctctgtcttttcttgaatttgaatttcctcaaaacagctaccttaaattctctatctgaaagtccatatatctctgttttttcaagattggttcctggtgccttattcagtttgtttggtgaggtcatgttttcctgcatggtcttgatgcttgtggatgttcatcagtttctggtttgaattgaagactctgaattgaaaagttaggtatttaatttgtctttgcagtctggtcttgtttgtacccatccttcttgggaaggctttccaaatatttaaagggacttgaatattatgatcttagctatatttgtattagggggcacccgaagatcagtagtgctgtgatttttgcagccttgtataggagccactatggtggtcttgaataagatccaaaagatttatctggattaccaggcagagactcttgttttattttcttactttctccgaaacaaatggagtctctctgtctgtactgagccacctagagctagggggtgcaaggacacaagcaccactgtggccaccatcactgggactgcactgggtcagacctgaagccagcacaggactgtgtcttgcccaaggcccgatgtgaaccactacctggctaatgcttatgtttgctctaggctctaggattctacaatcagcaggtggtgaggccagccaggattgtgtccttcctttcagggcagagttccccttggctttgggtgggtccagagatgctgtctggaagtcaggggctagagtcaaaaaccttaacaatctacctggtgctctattttattacaactaaactggtgctcaaaccacaaggcaaagttcttcccactctcacctctccttttcacaggcagaggggcctttccccctggccactaccaccacagacccatggagggtactgccaggttaccactaatgttcacttaaggcccgagggttcttcagtcagcctttggtgaatgctgccaggcctaggactcaccgttcagggcagtgggctccgctctggcctggggtaggtccttaaatgccatccaagagccaaggcttggaactggggaccccaaaagctcacttggtgctctaccccactgtggccaagttgattcctgaagcctgcctgaattagagtctcacccaaggcccatggcttactatctataggttattgctgctggttcttcagggaaaaagggctctttagtcagcaggtaattaatcccgctaggactgggttcttcccttcaaaacaggcagtttccttcttgctcagcgtatatctaaatataccatgttggaggtagggcacagaacaaagaccacatgactcttcccagtgcctctcctactgtggctgagctggcattcaagacaccaaagtcctctttgcttttccctttcgtctcctgaaagcagatggaaggagtcacttttgttgctgtgagccgagctacctggcttttggagaggggtgacacaagcacttccatagcttccctagctggtgtcccatatccactggctttgagcccagcatagcattaggacttgccttggaattgcagtccttgtggcctagatggctttgaaatttattcaagaccccagagcactttagcctgtggtggcaaggcttgccaaacttcaagttataactactgggatggactagtcccctctggctagtgctggtctaaatgctccctctgttcatggccattggctgagtttagccctgttttgcttctcactatgacagggcagcactgagttctacacagggtctcacaatcactgctgccctcttcctccaagtgcacagattatccatgccatgcagtggctggtgggaggatggaggagaggcagcatcagtgattcaactgtctttcttagcctcttcagtgcttctttcagcagtatggtgttaaaacaaggtactgtaattgttcacctgatttttgattcttatggaagtactgttctttgtagatattcaattgatgttcttatgggagggaaaattggtgaaggcttctattccaccatcttgcctcagttcattttttgacatacagataaatatttttcatcaaatttgggaagttttggccactcttccttcagacattcttactataatttcacttagctatcttctggtatttctattatgtgtatgttgttatacttaatggttccccaaagatctctgaaggtgtatttatttttctttattattttgcttcttgtttctcagactggtaatctcaattgatctttcttcaggtttgccaattctctcttttgtcatccttaatccacttttgatcatctttagtaaagttttcttttagttattgtaattttcaactttagaatctctattctttaaaacaattttttacctcttcattgatatgctccatttagtgagacatcatttctataattccttttactttttaaaatattattatatttagtttttcacacatatttataatatttacttaaattatttatctaggatttctcaggaagtttctattaactgtttttcttttctatgtataggcaatactttcttgagtttgtttgcatgtcttataattttgttgttgttgaaactgaacactttaaataatataatgtggcatattggaaaatccaatatcttccccacctcaggtttgtttcattgttctttgttgttgtttctattgctcttttttttttttaaagttcctttctcaggtctctctctaaagtctgtattctttcttgtgcatggtcactgaaggtggcttttttagattaatgtcaattaatgattacacatagatgtccttaaatgtcttaaaccaataaatgtgtcagggaacatcttcagtgctctagtaggcagttttaaacctcgttcctgtgcaaaaccttgaggctagccaggtgagatgaaggccttctcagctctctcttcctagacatgcaaacagccctgtacatacatgtggtgtcctagtttccttagaatatttagaagtttttcaaaggcttcaataaacatttcaattcccagtttatgtgtttgtcttaagttttttggtcagcctcttgttagttttaactagaattactgctttaggcatttgccatgttaaacaatagccattgagaattatcaacaaacatcctagggtttaggttttcttctctatgtgactcctaagtcagatcaaataaaggcacgccctgtgaatggtgccttttcataaagctggtgccataaatggtgccttttcataaagctgagaggtcaaagagtgacaattatctcgggtgtaccctttgggagtgccaaacttattttgccccatcaagtggcttctaggttgctcgttttcacagctgcagtggctctaaggctgctgattttcaaggctaaggtatctgaggagagaaaaatggaactaggtaaagttaaaatgctacaactctcattgttcttttaactgtctgtcttgaataaatgcagcttgcattgttacaagccctttctaattcctagaattctgaaaaagttgattttgagagtttatggcattcttcttactgtttttatggagagcagagctccttactccaccattctgaaagagcttttttggatgtttgattgataagttttaagagtccttacatattttgaatataaatcttttatcaaatatgtgatttgcaaatatcttttctcagtctgtgtctttccattccttaacagtgtctttttctgggaaattattaatttccgtgaagactattctattgatttttcttatattggtcttgccttaggtattaaatctaagaatttttgcctaactcaatgtcacacagatgttcttttatttcctctactatatttgagttttatattttacatttatgtcttcagaacttttttggcatattgtacaaggtatagatcactttttgtatttataatattaatatccaattgttaatcatttgtcaaaagaggattctttctcccactgaattacctttgcacctttacaaatgtatgggtctgtttctgaactctgtatcatctttgactgatgtatttgagtatcttgataccaatactacactgtctttgttactgcagctttataaatactcttgatatcaggcactgtaggtcctccttttgaaaaaaaaattttaagttgctttgccttttttaaggtcatttgcatttccacaagaattttaaaatcaggttacagaattactttttaaaatccttatgggtttgattgtaacaaagttgaagaaacatatcaatttgggagaacaggccttttaacaattgagtctcttatcattcctaatattagtaatttgtgggattttaaaaatccttgttagtctggctagaggtctttctcaaagaactaactttacattttttatcaactccatggttatacttctgtttatagttatttgatgttagttctgttcttctataatttattttttctgattattttgtatttcatttgctcttatttttctagttcctttgtggcaatagcaaacaacagaaataatatttatagaataaaaatatacaacctacattttcccatggcaacaaataccctacattatcttattttaatttttagaatattttatttaaaaatagagatggtgtctaaccagattatccaggctgatcttgaactcctgaattcaagcaatctttccacctcagcctcctgaagtgctgtactgggattacaggtgtgggccaccatgcctggccaattgactttttaatatcagttttataaccagaaattttgttaaattttcttctaagctcattatttattttgaatttgccacacacacgcaaatatatcatctgtcaataattggcaatgtatgctttttcagtatttctgaacaaataacacctgtagtagaatgctgaatcagaagaggtagctgacatctttgacctgttaaaagaaataatttttatattttatcacctgtatgatgagtatattttctgtagatgcattacaccaatttaaaatttttcacttcagtacaaagtttactataaaattgttttgaaattttaaaaatcatggttgattttgaattgtattaaatatttttctacatctagtgagcacagtatgttattttcctcttttaaactgttaatagtgaattgccacaaatactaagttctagtattcaacagcacagtaggaaaattatagttaaaaataatttattgtctatttcaaaataactagaacagaagaattacaatgtttctaacacaaagaaaggttaaatgtttgaaatgatggatatctcagttgccttaatttgatcattatatgttgtatagatgtatcaaaatatcacatgtaacccaaaaatatgtacaaactactatatttccataaaagaggaaaaaaagcaaccagagaataataatgatgggaatattgtggtagtggggagggtgctgtaggagtccaagagcctacatgctattgctctgctggaggtgccattgtaattgctccaggtgctgtagccattgaagagggaacaatcagactagagctgtgaggactgaggagaggttgctaaggctaaaggtagagttcccaagaagactcaggaatttgagatgcccatgaagcagggagatggagaggtaggaggtcaggggagagagagaaagagagattactaaggaacagaggctctttctcctctcctacctgttttttgtttgtttttgtttttgtttatgttttttgccagagtctcctactgagaagccaattgacagaggagtctgggaaattcagttttcaccgtctctcccatcctttacagagcagagtaagaggcattaaaaaattgcctaatattaaatcaaatttgtattgctaaaataaatattgttataatacattttataatattttctttaggatttctttatcttttgtacctacaatcacaaatgagaatgccctgtaattttcctaccttgtttgtgactctttggcttgaaaataaaggtttctccaactaatataaatgagaatgatgaagagtagcccctctttttatgttctctggaatagtgtagataattttgaaactgcaaattttgaaatattccttgaatatttgatgaaatgctcatagactcatcaggtaccagtgttttactgaagtaagatttttaccttctgattcaattactttatttttcatattttaaacctgcttgcttaatgtagacaataaccttcactcctaatatccacttattttaatctctacagcatctgtggctatataaaatgtattcctgacattattaatgtcttcattcattttcttgataaattttgtaagtaattgtctgttttattaatctctttacaatccgtttttcactgttgattacctctaatttgtataattgaattacataatgttattaaaaattgttcttattttatattttcacttatattttattttgctcaattttgttattctcttataacttgttaaatacattgttcactaattaattttagtctttctttgtataaaattattttcttatatttgtgcttagtggcaacccacaactttttctcttgtatatattttttaatttcaaatatgacttcttatttgaagcacgagatgttaaatctatgtttttacatctctaaatatattgttttaaattaattgcattgttgcttgatagtgttatttcaaaaattccaacctttttaaatttgataaaataagcttgttggtgttgtataaaattattttgttttaatattacaagtttgttggaatattatgttatgttccctaatttgggggtgtcatgttccataaaaattaagctttgtttaggtcatcatggtgtactgaatcgtttttgagaactaaaattttgtttcattattaagtgaactgcttcatttttattttggcttttttgccatagtatcaatatatctctcataaaatattgtttagcattatcccaacatacacatgttcacacactttagcttttattatttctgtaaccttggctttatatgcattccatgtataacatatagatgaatttttaaaattaattctcacagtctgtgtttagaattgcatgtggatatgttttcctacattattatgattttaatttctttttgtgtctttttttattttttatttgaatgctttctttttctttctttccttccctttaactctttctttcccttctacttttccttctatttgtacagaagtttttgacaccatggctagttttttagaagtcaagatattttaatatgtgtatataacaatgaattatctttaccctacttttgaataatacaaaagtttccaaattattttaatcaaatttctatttttccacatatttcatccactaaataattgaagcctttatacttttgtatcatgtattgttttaatgtacaagcactttttgtggagatttatccaaatattgataggatgtccttgctcttgtctgccttttttttttttttttaattctaatgaagtacatcctctatagcagcagtccccaacctttttagcaccaggaaccggtttcgtagaagataaattttccacaggtggaggagtggggtgggcagggggttgttttgggatgaaactattccacctcaggtcatacggcattaaggcattagttagattctcctaatgagaatacacaacctaagtccctcttatgcacagttcaaaatagggttcacgctcctatgagaatctaatgccatcactgatctgacaggaggtggagctcagatggtaatgcttgctggtccctgcttacctcctgctatgtggcaggtcctaaagaggccaccgaccagtaccagtctgcagcctggggactggggattcctgctctagagttttcctaatgtgcaacttttggatataaatgcagattttgttttacctaaaatgttttcattcttcctaatgccatgataagcaaaacaccgaatctcaatatctgataccatggaagtttatttctcattcatattgaataaaagggggaattcagcaggctgcctccattcagtgatttgggtatcccctcttatcctgtgtctctgacacccattaagaaatctaaattcttcactttgcgacagcatagggtaagaagaaaagagaagggttattcagttacatatttttccaggaagagagacagaaagaaagagagaaaaaggaaagaatgtggatagggtacacacaagccctatctacattctattgcccagaattaaaacatgattccacctaatttcaagcaagtgtgggagaaataatctaagtatgtaccagaaggagaaggaacaatgttttggtgagatcagagcattccctgccagacctttcttttagacagataagtacgtgtttagaatctgaggttgagagttatttctctcagaatgttgaaaatactatttcattgtcttattttcccaatattatcttttcccaatatcaactgacttggaaaagtcagttgataagctaagtgccttttaggtggttcacaagttttctttgatattttaaatctctttgtctatcagacatactgggggaattgttttagtactttaatgtgtactttctctgtctctctccttgtctcctgctctctctccttttctctctctcttttttttctctctctctacgctacacacacaattcgtctatatgtatacatatacacacagtatacaaatactcaatttgtttttgtatatataatttttaacatatttaaaaagagccttagtgggctgtattagtccattgtcatactgccataaagaaatacctgagactgggtaatttctaaagaaaaagaggctaaatggactcacagttccacctggctagggtggcctcataatcatggcagaaggcaaaggaggaggaaaggcatatctcatatgatggtaggcaagagagtgtgtgcagggaaactgccctttataaaaccatcatgagacttattcactgtcacaagaacagcatgggaaaatcctgcccctatgattcaattacctcacactgcgtcactcccatgacacatggggattataggaactaaaattccagatgagatttgggtgaggacacagtcaaagcctaccattccacccctaactcctcccaaatttcatgacctcacattgcaaaactaatcatgccttaccaagaatctcccaaatcttaactcatttcagcattaactcaaaagtccgcagtcccaagtctcatctgggacaaggcaagtccctttctcactatgagcttgtataatcaaagcaagttagttacttcctagacacaatgagtgtacaggccactgggtaaatgtacgcattctaaataggagatattggccaaaacatagggcagtccccatgcaagtccaaaaaccaatggggtagtcaaatcttaaagctccaaaatgatctccattacttcatgtctcacatccaagtcgtgttgatgcaagaggtgggttcccatggtctttgaaagccctattgctgtggctttgcagggtacaactccccttctggctgttttacaggctggcattgagtatctgtggcttttccaggtgcatggtgcaagctgttggtggatctaccattctggggtctagaggatggtggtcttcttctcacagtcccactaggcagtgccacagtggggactctgtgtgggggctcccaccccacatttaccttctgtactgtcctagcagaggtcttcatgagggctggcccctgcagcacacttctgcctggacatccaggtatttccatacattgtctgaaatctaggtagaagttcccaaaactcaattcttgacttctgtgcacctgcaggcccaacaccatgtgtaagtcaccaaagcttgaggctttcactctctgaatcaatggcctgagctgtacattggccccttttagccacagctgggatgcagggaaccaagtcccaagactgcacaaagcagcaaggccctggacccagctcacgaaaacattttttcctcctaggcctctgggcctgtgaagggaggggtgccatgaagtcctctgacatgccctggaaagattctcaccattgtcttggtgattaacatttggcccctcattacttatgcaaatttctgcagctggcttgaatttctccttagaaaatgtgtttttcttttctattgcatcatcaggctgcacattttccaaacttttttgctctgcttcccttttaaacgtaagttccaattccaaaccatatctttgtgaataaataaaacagtgcttataagagcacccaagtcacctcctaaatacactgttgcctagaaatttcctccatcagatactctaaaacatctctctcaagttcaaagttccacaaatctttagggcagtggcaaaatgccaccagtctctttgctaaaacatagcaagactcaagtttgctttatttcccaataagttcctcatctccatctgagaccacctcagcctggacttcattgtccatatcactatcagcattttagtaaaaaccattcaacaagtctctagaaagctccaaactttcccacatcttcatgttttcttctgagccctccaaagtgttttaacctctgcctgttacccagttccaaagttgcttccacattttcaggtatctcaatagcagtaccccattctaccagtaccaatttactatattagtccattttcacactgctatgaagaagtgcctaagactgagtaatgtataaagaaaagaaagtttaactgactcacagttccacacggctggggaggcctcacaatcatggcagaaggaaaaggaggaacaaaagtatgtcttacatgacagcaggcaagaaattgtgtgcagggaaactgccctttatgtaaccatcagatctcatgagacttattttctatgatgagaactgtatggaaaaaacaagaccccatgattcaattaactcctaccacatccctccaatgacacatgggaattatgggagctacagtgcattatgagattagggtggggacacagccaaacatatcatgggctttttaattaacagctttagttaggtataatttacatatcacaaaatttactaattaaaacaagtaattcaatggcttttagtacattaataatggtttcttttttgaaggaaattctgacatttgtaacaacaagaatgaatctgaaagatattatgttcagtaaaataaacaagacacagaaatacaaatactgcataaactcaaacatgtaatttttaaaagttgaactgatagaagcacagagtaaaatggtggttgccaggagctgggacaatggggaaattagaaaatgttggtcaaagggtacaaactttcaggtatagatgaattaattctggaaatctaatgacagcatggtgacttagttaataatgctgtgtaatttacttgaaatttgctaagagaatagatcttaagtgtcctcaacaccgcccccccacacacacagagtaactatgtatggtaatgaatgtattgattaatttaattgtagtagtcatttcacaaggtatacatatatcaaatcattacactgtcccccttgaatatgaaactgcctttataaaattaatgaaaggccccagttaaaactgtggagggttctgaattttgctaagagataaggagagttatataataaccagtcattgtttctttgcttgcccttttattttttaactgtttactgctcagaagtcacatagtcgtcacaagatatgtaacttcccaattgatcatatagataacatcactattgtgaaacctaagtctattttgtgagatattttggagactttgcatcctggtggaccaactgactccatccagactggtgaaccataccaaggaactaactcaattggatctttgatgccctcccaggaactgacttcatgaacaaagacagttttgacacccctgtgatttcatccctcatccaaccaattatttgtacccatttcctagccccctgcctgccaattacccttaaaaaccttaccctccatattcttgggaagatagatttaagaaatattttccatctcctccctcagctgccctgtgataattagattctttctctactgcaataccttttgtctcagtgtattggctttctctgtgcaatgggcaagaagaatctgcttgagctataacgaatatgttcaatttttatttgtcaataatatctcaataaagcttgaaaaatgggatcttttaaatatatattttatctatctttgtttcatttacctttttcttaataaatcccttttaatggaatttatatgtgtatttaagaaacatacttactccaaaacagttgataatattttgcactgttaaactatattaattttatttctatagaattataaaccaagagtttacactgtggcattttatttcaacattatatttctcactagttttagaattgaagactaattttgacaggaatcttttcgttttattacttttgaattctgtttcccctcttcatgtcaaataagtttgactttgcttttattgacagttttgttcactttgtctcatgggcactaaaattcttgctactctggaagccataggttcttggccccctcagtggtccctgaaagccattgacatgaggcaggtggtttaataagagaaaaggcatacacatttatttaagatgtatacataggagccttcagaatactctccttcccaatgagttacagaaacttgtatacaatctaaaggttacagaaagaatggggacttggatcctggtaaaacagattatgagagggggtagagaggaattctatttagggacaatacatacttactacataagaatgaatggatcagtgaacagagactagcttgtaaataattctctttgaaacttaaatgatccttggaagcagtctttatcttgagaagaaaggcctgttcaagtatagttacccttttggtcttacagggagggaaggaaaactattgttcttggtgggtctgatcatagccagataaggaaacttcagcctctttgggagaaatggtgaagggtgggggaaggttagagaaaccttgaggcttctacttcagtttagtatgtcaaaacacaggatttggagatattggtttctgagccccacaataccacatattttcagacaacagtgttcagcaaacccatagcttctgcccattaaactgtttttcattattgctccatttctagtctacttagggttatggtaggattgtcccatgtaatatttaaaacatacttatgagacagagtagggacagacctcagcccttcaactgccactaacatattgtttcttacccactgactaggggacttgaagaaactaagataagcagcatcccaccataagtttaatcaaggtgccatacccacagtgtccccaccttaaatcttactcaagggagttaaccctatcacctgcagaagaccagattaatgaccaatttttaccccttacctcattatagtactaaagtgtctgtccagggaggggcttatctgccatttttttatcatgagatatataaagatgtatgcttctacattgcacttgcatgaatgaaacccctccctacttatgcttacctacttttcctttaacctcgacccctctccctccccaaataaaaggtcctaagcagcccttctcagagagccagccagggaactcttgttccagtgctgtctcccttgagttcaagcacaagcccctaataaagcttagtctgggaaacttacttggccttaatttctattgcataggagcctaagaacctgtggtcagtaacatttacactaaaatattattttctacttatatgacatttaaatataacttggcattctgtaattttatttgctaagatctatttctttctttcttttttctgtttttcttttccaaatttgtctctttatcttctataaatgtttgaagaaggtaatatgagtaaaatgtaagtaattgtgccatcctgaacgtcatacattactttttaaatcagagatacgtgaccatatgaagagctacaaccatccagaaactgaagcaaaaatagctaaaatctggtgcctacagtcactagaaccagtaaaagacacagaatttaaaccagattagtgaataatgtttgcaggacactacattgtttaataattttaaagaatgtttccatggatatataagcaggttgagcacattcaggatgcatgttggttcaacctattagaggcatactttgaagatattccaaattcagttcaagaacactgcaatacaatgaataaagtgaacacactaacgttttggtctcccgatgcatataaaagttatgtttacactatactgtagtctattaagtgtgcaatagcattatgtctaaaaaagcagtgtacatacattaattaaaaatactttactactgaaaaaaagctaaagatcatctgagcctttagccaatcataatctttttgctggtgaaggattttaccttgaagttggtggctgctcactggtcagggtggtggttgctgaagattacagtggctatggccatttcttaaaataaaacaaaaatgcagtttattgcagtaattgactctctttcacaaaatttctctgtagcatgagatgctgcttgatagcactttacatacagtagaacttctttcaaaattggagttaaggctctcgaattctgctgctgttttatcaactaagtttatgtagttttctcaattttttactgtcatttcaacatagcatcttcaccaggagtagattccacctcaaaaaccactttctttgctcattcataagaagcaacccttcatccattcaagttttatcatgagattgcaacaattcattctatcttcaggctctacttctaattctacttctcttgctattcctactacttttgcagttacttctccactaaagtcttgaatgctttaaacacattcatgaggattggaattaacttcttccacccaacctgttgatactgatattgatattttaacctcctcccatgaatcatgaatgttcttaatggcatctaaattatgaatcctttccagaaggtttccaatttactatgctcagattcatcagggctttactatctatggcagctatagccttacgaaacatacttttaaaataataagacttgaaaatcaaaattactccttgatccatgacctgcagaatggatgttgtgttagcaggcataaaaacagcattcatttctttgtacatctatgtcagagctcttgggtgaccaggtgcgttgtcaagaagcagaaatatttttaaagatttttttttctgagaaggaggtctcaatggtgagtttaaaatatattcagtaaagcatgctgtaaacagatataccgtcatccagtctttgttcttccatttaagagcacaggcagagtaaaattagcataattcttaagggtcctaagatattaagaatggtccatgagcaatggcttcaacttatagtcaccagttgcattagctcctaacaagaaagtcagtttgttccttgaagctttgaagtcaggcattgacttctttctgactatgaaagtattagatggcatcttcttttaatagagggctgttttgtccacactgaaaatgtgctgtttagtgtagccaccttcatcaatgatcttagctagatcttttggataacttgctgtagcttctgaatcatcttgctgcttcatcttgaacttttatgttatggagacggcttattttcttaaaactcatgaaccaatctgtgctagtttcacacttttcttctgaagcttcctcacctctcttaacctttatagaattgaagaaaggatcttactctggattagcctttggcttaagggaatgttgtgcctggtttgatcttctagctacattactcagactttctccatatcaacaataaggttgttttgctttcttatcatttatgtgttcactggattagcacttctaatttccttcaagaacgttttctttgcattcacaatttgactaaatgtttgatacaaaaggtcaagctctcagtttatctcgacttttgacatgccttcctcactaagcttagtaatttctagattttgatttaaagtgaggatgtgtgattcctcccttcatttgaacacttagaggccactgtagggttattaattgacctaatttcaatattgctgtatctcagggaatagggaggcatgagaagagggagagagatggggaaaggctggtaagtggagcagtcagaacacacaaaacatttattttgttaagttggccatcttatatgagtgcagtttgtggtgacccaaaacaattacaacagtaacaccaaagattgctgaccacagatctccataacagatctaataataatgaaaaagtgtgagaattaccagaatgtgacagagactcaaagtaagcacatactgttgggaaaacagtgccaatagattcgctccacaagggtttgccacagagcttccatttgcaataaaacatgtaacacctgtgaagctcaataaaacaaggtacgcctatatatgaatggttatttaatctgatgcttttagttctcttttaatttttaaattgaacaataagatgtgcaaataactgtgtaaaaattgtcctattccagccgggtgcggtggctcacgcctgtaatcccagcactttgggaggccgaggcaggtggaccacgaggtcaggagatcgagaccatcttggctaacacggtgaaacccaatctgtaccaaaaaaatacaaaaaaaattagctggacgtggtggcgggcgcctgtagtctcagctactagggaggctgaggcaggagaatggcgtgaacccaggaggcggggcttgcagtgagccaagatcgcgccactgcacttcagcctgggccacagagtgagactcctctcaaaaaaaaaaaaaaaaaaaaaaaattgtcttattccttgagctttttctatgaaatagagcttgtattgtactgatttcttaaaataatttttgttatttttgcatttttatgctttaaaaaaatcagttgattcctttacaatgtgttgatacactctagaatcgttcattttccattctcatctgctgaaaataatattagtttagatttgttgtctcatgggctgcttttctttttattttctgtgtgtgtgtaccttgaatgtatccacttactcattttatttaggtactgacttactgtcttattgcttttttcttatgctaatattttatcatttctgaaagccacaagcttttattacccttcaaataatccctaagatacagagatgtgaagagtgccctttattctatctctgtgcctatagtattttgtcattttcactgttacagcaaaatggctttgtgcatctccttgacgtaaacaggaatagagtgagctgagattaacagatattggacagtccaactcacacagtgtagtcatggttaccatcaaaatactatggcaaatgagtgaccaaatctataaagaatatatttttaaaatagtatctgttggcatttttctaacacttccctcaaaaatcaacatcattgactggaaaacaccttataagtttattgacattaatatagattggtatgatatacatggaaaaaatgcagaatgtctaataggaatataggaaaggggagtactgagaattaaccatgatacagatcctttctctttctctcacaaaaacatattcagatacttcctaatacttttaatcaatgcagttcactaaaagcttcatgtgacatagcgtcagtaaatgttgatgttccccatatgtttaggcaatacttaaaattctagagaaatgacatttttctattaaattttttatatcactgaagattaaatttaaataattagcagcataagttgtttacagtgaagaatgtagtgtattcaactgcaaaccaattatgataatattattgaatttaatgtagataacattaaaacattctttttaaagtcaaaataatatatatattttatatcagtttaacaaacatttataaactatcaacctggagtaagaaaaccaacttatgcatgtgtatactatgttttatacatacttaagaatgctatataatttatatatgagtatcaaagtctattgtatttaaaaagttgtgaacacatctctatcagcataggtaattgacaatttagttctctctagctatgaaaatcttagatggcaacttcttttaatagaaagctgtttcatcgacattgaaaatctgttatgatttatacagattattacatttctaaaaaattatttaaaggaaccgtatgtatattcttctgggattgtgataaaggattcataatagagagattccatgccttaggacacacaatcttctctgttcccattctcttttttttttcttttgagaagaaaaggctcaccgcaacctccacctcctgggttcaagagattctcctgcctcagcctcccaagtagctgggattacaggtgcacggcaccatgcctggctaaatttttttgtatttttagtagagacggggtttcaccatgttggccaggctgatttcgaactcctgacctcaagtgatctgcacgcctcagcctctgaaagtgctaggattacaggcatgagccaccatgcccagccctctgttcccattctaatagatgttctactatggattctacattatggcctatagagttagccttcgactgacgtaaaactcagggaataccttgaggaaatctaagtgagcagaacaagggccaaagcgagctgggaagtgcagaatatacgttcctggtccaaattatagggacaaaagagaaaaacagtgttatgtcacattaattaataaatttgagaaagtaagattattatttctaaagaaatgatactcagagagaagcaaaagatttatgctatgtcgaggcagaatataaagagagtaaagcaaaacagataaacagatcaatccaaatcactataatttttttttcctgtgatgctgccagcagcaatgggtctaggaaccccttgatgtccagtccttcaagccagcctggttttttgttcaacttagaaattaagaattactttattgatatttttgcctatttattctttgagatggagaagaaatgattgaaacacctcagaaacaaactttatttcaaccattgtgctcactttttgtacaatacctttttaaaatatttttctattttgctatatataatcattgctgatattggtaaaacatacaggttttgaagataattgataatgatccagatttttggaaacatagtcagtaaaacacaaatatatttaactaaccctgttttataaacaggagtaagccattaccattgcgaccacaaagtgctcagtaggcaatggctaaaactggcaggaaaataaatatctacagaatatcaacctggctttatttttaaaagtaaaacaggaatacaaatgatggagtaaatactctcaggtggcagatgagaaaatatttggaaagctataaaaaggaatatgaaatcgggcctggatagatggttaagggctgtgtcacgtggacaaacataaggaaggtcattccagaaggagacatagcactaaccagggagttgagtaaggagggaacaaaatattatcttgcttttaaagcatacggggggaaagcctagagttaaaagccatgatcccattcattttctagaaaagagtaaaacatttgcatttttaaaagagccaatggggacttactgattttccctttgcactaaacatgatcacaaatgtttaagaaatctgatgtgaggagttgatggggtagatgcatgaagaaataaactagagatacagagattagggagctgatgctcgaaactttgtgacagaaaatacatgcaactaactattgtcagtatggaatgactacaatacagttgttgagggcagaaactatgtttatatttactcactgatgtgtagtacagtatgaagaacatagcaggttttcaggaaaggtccactggccatcccacatgtagttttacgaatgctgaataccccaattttctaaaatggccacaacgctggataccatatataaatgtacttttaaaagtgcattgcacaaagaacatggaaataacaataatgcatgatccatttacaatgatcatgtattatatttgggggagggagttgaagtttttctgagagcatgggatgcaaggattgcctaaagcaactcgaaaatatcttaaggaagtttatttaaaaaatattgataatatgtttcctcctagtaaggtggcaacatataaaattgcagtcattgcacagtcagtagttctcacttaaggaagaagggtgtaaactcactgacagaactctactgcccactgggaggtttcataggagaaacagaaagttaatgagaagagccctttgtgttccaagcaatccattggttgtggcctcagcacacagagcactactaacagagccacttgcagtttcacctttctttggcaattcagggagggcactttgatgtgtttcttgatttgccccctgttgcttcctcttcaaaagcctgaggatgactaagcttgtatctctcagcctcatgtgaacctcagtgcagcaacatttcaaatttggtacccatctttgaagtgtagtggcttgtacacattaacattcttgcccccaaagacttcttttcttgcaatctttccttccaagtaatcacacatctctcatacccaggtaaatttagaggctgcaggctgaatgagtaaccttaataaaatatctcctattatttaattgctagaagtaccacaattttccccccagcatctaaacataaaacacttgcaacatatagtttgttgattcaccttattttaatttactatatttagtcaagtgttgtttttaaatgtcccttatgtccttctatccttcctttctacccttaaaatagttgacctgagttagcttatactcaaaggtagaataacatgatcaagaagttgagagattaagaagtcatgcatgtctaactttctgctcaagcttgtgaaattccaaggaatccctatatattgtattaacaaataacagatgcttctatattaatagaaaatacataatgcaacttttttttttcatttcatggtgattatttcagaggctactgtccacctgcttacccagtttcttggcgtaagagtgaatgataagaggtgaaaaaaaatacactgaaataaacaaggcagtatttaagatataagatgaagaaaataacaccaagttatattaagaaaaacccataataatatgagcatctaatttttttcaaaatttttgaacaaaataaatgtcagttctccaaagccttgtgcttagctgtgaatgtaaataaatctaaaatatcctttgttcctttcttccttcttttctttctctcttcctctctccctcttctctccattcttccactctttctctctttttctctctcaataactcacatatagggaacaaaatgcaaaagaagtaaatgagtacacagtgaaaattatggcttccgcacatctttgttttttatcgacaagggagctgtccccagaagcagagaatgtagccagattcttgtgtatcctcacaaaggtattttacatatattcagatacatataaataaaataagtaggtttcttatggatcacattatgtggtcgaggaaaaggttttgaaagagttaaatgataagcttcaaggttatgcagaaagtcagcaatggagttggggatgagcccagattttctattttactctaggcattgtgccatcttgcaaatttttatcttctaaatgccagtatttctgccttttgtatggatgggcatatctccaagggttttaaatttgattctggttcaataactcaccctaagaataaatgaagtatatcaatctcctttgtatgcactatttcaacctaaacaagtaggtgggtcagtttagggttctttgcaattttgaggatatttatgaacatcatacttagcttgagaggctttacttcttttactgtcttagaattctgctcgcaagtaaaaaccaaccaaacaaaaaacaagtacaataataaagcttcagtatgaaaaacttatccaaatagtttgaaattttaaaagtttttacttaagtttggtcaaagacgtattcttcaggttcacatttcaggtatttactttgaataaattatctcagttccataggtcttagctcttctatagaactttgcctttgctagcatattttcattatatagcactgcagagaaggattgccataaggatgggaaggatttggtactatgtccttgctagtatctttgacacaaggtcttcagaaaaaagtttaattttaaaaaaataagtaacaagtgttagttcagcagataaaacaaactaaaaataattaatgatatcagttttaaatatttaaaacaccctccattatcagtaacataaagcctaccaaccagaaaaagcccaggaccagatggattcacagctgaattctaccagttatataaagaagagctactactattcctactgaatctactccaaaaattgaggaagagggaatcctcctttactcattctatgaggccagcatcatcctgataccaaaacctggcagagatacgataaagaaagaaaacttcagggtaatatctttgatgaacacagatgcaaaaatcctcaacaaaatactagcaaactgaatccagcagcacatgaaaaagctaatccaccacgaacaaacagactttatccctgggatgcaaggttggttcaacacacacaaatcaataaatgtgaccaccacataaacagaactaaaaacaaaaaccacctggtcatctcaatagatgcagaaaaggcttttgagaaaattcaacatcctttcatgttaaaaaccctcaacaaattagtcactgaaggaacacacttcaaaataataagagccatctatgacaaacccatagccaacctcatagtgaacgagcaaaagctggaagcactcctcttgaaaacctcaacaagatcaagatgccctctctcatcactcgtattcaacatagcattaaaagttctggccagagtaatcagagaagaaaaagaaaaaacacacacacaaatgagaagagaggctcaaactatttctttttgcagatgatatgattctatacctataaaaccctgtagtctctacacaaaagcaccttgatctaataaacaacttcaacaatgtttcagaatacaaaatcaatgtacaaaaatcagtagcatttttatacgtcaacaatacccaagctgacagtcaaatcaagaatgcaatcccattcacaataaccacagaaaaagaataaaatacctagcaatacagctaagcagggaagcaaaagatccctataatgagaagtaaaaaacactgctcaaagaaatcagaaataacattaaataaattgaaaaacattccatgcttataaatagaagaagcactattgttaaaatggccatactgcccaaagcaatttacagattcaatgctatttctaccaaactaccaatggcattcttcatagaattagaaaaaactattttaaaattactatggaaccaaaaaaggaacctgaatagccaaagcaatcctaagcaaaaagaacaaagctggaggttttacattacctgacttcaaactatactacaaggctacgataacccaaacaacacagtactgacacaaaaatggacacatagaccaatgtaacagaatagagagcccagaaataatgcctcacacccacaacaatcagatctttgccaaagctgaaaaaagcaggcaatggtgaaaggaccccctattcaataaatggtgctgtaataactggctagacatatgaagaagactgaaactggaaccttctcttacatcatatacaaaaatcaactcaaggtggattaaagacttaaatgtaaaacctaaaagtataaaaaccctgaaagataacctaggaagtaccattctggacacaggccctggtagagattttaggatggagacaccaaaagcaactgcaacaaaacagaaattgacaagtagggccaattaaactaaagagcttctgcacaccaaaagaaactatcaacagtgtaaacagacactctacagaatgggggaaagtatttgcaaactatgtatccaacaaaagtccaatattcagaatctataagaaacttaaataaacaagcaaacaggaacaacctgattaaatactgagcaaagaacatgatcagatacttttcaaaggaagacatacatgtagccaacaagcatataaaaaaaagctcagcatcattgatcattagagaaatgcaaatcaaaatcacaataagataccatcacacaccagtcacaatagctattaataaaatgtcaacaaataacagatgcttgagaggtggcagaaaaagggcaacacttatacactgatggtgggaatataaattagttccgccattgtggaaaacagtgaggtgtcttctcagagaacttaaaacagaagtgccatttgacacagcatttccattattaggtatatacccaaaggaatataagccatcctaccatacacatgcgtgtatgtgttcatcatggcactattcacaatagcaaagacatggaatcaacctaaatgtgcaacaaaggtaaactggatagagaaaatgtggtacatattcaccatggaatactatgcaaccatgaaaaagaacaacatcatatccttttcagcaacatgaatggaggtggaagccattatcctaagtgaaataatacaggaacagaaaatcaaataccacatgttctcacttataagttagagctaaacactgagtacacatggacacaaggaagagaacagacaccaaggcctacttgaaggtggaggatgagaggagggtgaggatcaaaaaactctctatggggtactgtgcttattacccatgtgacaaaataatctgtacagcaaatgcctgtaacatgcaatttccttctataacaaacctgcacatgtaccccgaacctagaagttaaaaaaaaaaaaaaacagaaaaatagaagaccatccttcgtctaataaaaaataaagaagatataagtaatatttctattatgggttcccaatatacttctgttgcaggacctcagatactatgttcctgtttccctaaacatttttggatgtttctggttgtgttctttactcaaagcccctttggctattttccttccatcaagaaattgagtcaattttgtcttcctttaaacctgttcttgaatcttgtgacttgctttgaaaaatacatgtagttgaactaaagttataccagttctggagcttaggccttaagactcatggaaatctctgttttcatactactagagactgctagagactggagaaacagatgtataagttaaaagacagtctaaaaaaggggtcctagagaatgataaaacaggaaagagagtctactatttgagccagtcccattgaaaagcaagaaagtgagagagaccatcctgaattctttagctaaaattgtggatgcaggagtagcccagctgacacaacatagagaagacttaagccatcccagctgagttctgtctagacaaccgcgaaactcgtgaacaaataaaataattgctatttcagacttcagttttgaggtaatttgttatacaaaaaataatgttttcctaaaaaaaaccctgcattctgaaggtaaaattattgactaaatttaatattcatatctcataagatagtatctgtttaggctgctataacaaaacagcataatctgcatggcttttttaaaaaatagaaattcatttctcatggttttgggggctggaaagttcaagatcaaggcattgggtgattaagtaactattgaaaactcacttcctcataggcagtgccttctcactatgtcctcacacagtgggagggacaaggaatctctctagggactcttttttttaaagatactaattacaatcataacggctccaccctcatagcttttgtgtgttcttttttcttttattttttcgtctggacagagtatcactctgtcacccaggctggagtagcagccttgacatccttgactcaaccagtcctcccatctcagcctcccaagtaggtgggaccacaggcaagcaccacctactttttttttttcagagatgagatctcactatgttgcacaggatgctaaatatcatccaaatcagatatgagtgaggttcaaagtgtgattcatcctgagaaaaattactttccagctgtaaactcatgaaataaaacatgatacgtgcttctaaaatacaatggaaggacaggaacaggataaacattcccatcacaaagagaagtagaaaaaaagaaaggaatgacaaatcaaagccttaaagttcaagaataattgtttttgtctcaatgttctgccctccaaacccactggggtataagtttcaccttccagatatactgggacaggattcatgctcccttagctgtgctgggcacagcccaaccctcagctctcatgaaatggcgtcatattgtgtccagaattggtgggttcttggtctcactgacttcaagaatgacactggggaccctcatggtgagtattacagttcttaaagatgatgtctccggaatttgttccttctgatgttcggacatgtccgaagtttcttcctgctggtggtttcatggtctcgctgactttaagaatgaagccacagaccttcatggtgaatgttacagttcataaaggtagcatgtacagagttgttcattcctcccagtgggttcgtggtctcgctggcttcaggaatgaagctccaggccttcgcactgagctgctgtgcaaatccaaagacaaagcagcaacaagattcatctcaaagagcaaaaaagcaaagcttccacagcatggaaggaaatcctaccaggttgcgctgctggctctggtggcctgcttttattcccttatctggccctacccacatcctgctgattggtccattttacagagagctgattggtccattttacagagagctgattggtccgttttgacagagtgctgattggtgcatttacaaacctttagctagacacagagtgctgactggtgcatttacaatcctttagctagaccgaaaagttctccaagtccccacctgtcccagaagtccagcggcttcacctctcactggcactggccctgggactttgtggcacctagcccaggcactccggcagcccagagggagcttgtcccagacaaccaagaggaaaaggggggaagcgcgaaagagatggagacccgccattgtgggcaacgaccctgcaaagagggaacggcggtccacgcatgggacccagcctccgatcaagcccagcaggcacaggccagctgcactgagtgcagggccgcggagcccgcacccacccggaacccacgcctgcccgtgagcgctgtgcacagccccggctcccacgcacgcctgtccctccacacctctccgcgagcagagggagctggctccagccttagccagccccagagagggccccccacagcgcagcagcgggctgaagggctcctctagtgcagccagaggaggcgccgagagccagctagggctgctagcacgttgtcacctctcaatatgcctgtggctgtcctgtgtgagttggaatataatactggtgtctctactcatctggtggagaaggggcagctcacccctgtgaatctactggagattgcccttatggggactctttgcagtgaccctgctcccatggcagttttttgccacacggctccctggggcatcctttgaaacctaggtggaggcagccacatccccacagttttactgggcatagtgagacagcaccagagccacacacccaacacagcccaggagcatgcaacacagtagtatgagaagtgaagcatttacacagtgccagccagcatgcgccaaggacctgcaggcaacagtgtccccttctttgaaatcattctgacccccaggtccttacattctggacttgtaatgggagggcaaccctgatgacctccaaaatgcctcccagtattctttcattgtcatgaacaatgggtcctggattttgtttagatggctgactaatctctccattgtcttaacagctcccagcttctgttgatgtggccaatacatgttaatctctttatcaaatttggccacaagtttgataaagagatttatatgctctcccaaacagattttttttcatttattgtaatatggatggctgagaattatccaaatttttaagttctgtttttctttttattaacaattctgcctttaaatcatttctctgttctctaatttactataagcagtcaaaaggaaccaagacacgctttcaacacttggcttagaaatagattcagctaaatatccaatttcattgctcacaactaccttccacaaaacactaggacaattcagccaagttatttaccactttatcataaagatcacctctttccttgttttcaataacatgtttcttattttcctctgagactgcttgagaatgacccttattaatcatatttctactaacattctgttcatgaccacttcaatattccctaagaaaattggggatctctctacagctctcctctctctgaatccttaccggtattgcctttagcagtctattcacagcaatataagctttttctagcatgcaactcaaaactctaagacttctgaccattactcagtcccaaagccattttcatttttttaggtatttgttacagtagtacctccactctcagcacaaatcttctgtcttagtacattcaggctgctataacgtaacacactaggtggcttataaagagcagaaatttatttttcacatttctggaggttgggaagtccaagatcaaggtggtagcagattcagtgtctgatgagggcctttttttggttcatagacggccatattttggctatgttctcacacagttgaagggacaaggtagcattcttgtgccacttttacaaggccactaattctattcatgagggctctgtcctcatgacttaataacctttcaagggcctcccctgctaattccatcaccttggggatttgaatttcaacataagaattttgagggggcacaaacattcagaccatagcagctacgcactaaatttacatgtttaaattttacatgctattgtttgcaataacacataacttttctttgtttattttttttgagatggagtcttgctctgttgcctaggctggattgcagtggcacaatcttggctcactgcaagctccacctcccgggttcacgccattctcctgcctcagcctccggagtagctgggactgcaagcacccgccaccacgcccggctaaattttttgtgtttttagtagagacggggtttcaccgtgttagccaggatggtctctatctcctgacctcgtgatctgcctgcctcggcctcccaaagtgctggaattacaggcgtgagccaccgtgcctggccataactttttaaatatatattttttgagacagagtctcactgtgtcatgcaggctggagtgcagtgacactatagccttaacctcctgagctaaagagatcctcccacctcagccttcctagtagttggcactacaggtagtgtgccaccatgcctggctaatttttttttttttttttttttttttggtagagataggttttaccatgttgcccagtttggtctcaaacttctcagctaaagcaatcttcccacctcagcctttcagagttttggaattataagtgagaactacaaggctcagccctgaaattttttgtacaataacttgttttaagaaaggcacaatagtctgaacatgttgagaagactgaatggggagggggaggatttagagaggggcatgtggaaaaattgggggtaaaaatgttcatttcttgattatgatgagagtttaaagggtttacacatatgtcaaaacttagcaaattatatactttaaatatgtatagtttaatgtacttcatttatatgttaataagctgtgaaatgtcaaaataataaaatggctataatacatatttttctaccaaatagtttctttattcaataaacatttgatctgtgtcaatactatatccctgtgctcatggaagtccgaccagtgtggggatgctgctatggtggtgatatgatactgtggcacaatgtgtgcaaaactgtaggaggagagagagagtgatcactttttaacacagtaataacagataagtagaaccctacaagttacagatgatacaaagaaactctaagcaaaggaaaagcatgcaaagtcattgagacaaaagaagaaagatgtccttcttcggaaagctgtgcacctcaatagacttgctggtagaaaatgaaattcaaactgtagggccttgaatttcacgcaaaagaatttggtctttatgtgttagacaatggtgaataatatgtaaaagcaggattatatctatattttagaaagataactgagacaggaagatgagagggggcgctttacatatttcttcaaaagagagatgatgaagactttaaagcaacagcaaggaaaagagccctaataaacatggaggtagagatgacaaggtgtgtgggaggctcagataatataataaacatgactatatttcaaaggtctcaataactatttcatattgggtattactgaactaatacgtcatttcagtaatataaaatcatatatggctttctgtaatatgttttggattaaggttttagattttgtgtccaaatttatgttggaattatagttcaaagtatatatgcattgatgtttttatggctcttgttaccaaataaatctcaattaataagtgtatgttttcctacaaataaaaataattttatttttgacaaactgataaataaaaaaattttggggggtttgccatttgtttatttggcgtcaattatagtgatttttccatatagtttttaaaaattcagattgcttctttctattgagggccacaaatcttgccttttattctgaaaaaaattcaaagatatattggcactatgaattatgacatagaatatgatacaagtaggaagttgtattagtccattctcacactgatctaaagaaatacctgagactgggtaatttataaagaaaagagatttaattggctcatgtttctacaggctgtacaaacaggaagcatagcagcctctgcttctggggaggccgcaggaaacttacaactacggcagaaggtgaacagggagccagcacttcacatagccaagcaggaggatgagcaagagggaggagatgctacacacttttaaacaaccaggtctcacaagaactcattcactatcgtgatgacagtaccaaaggggaaatccacctccaaaatccaatcacctcccaccatgcgccaccactaactttggggataacaatttgacatgcgatttgggcagagacacagatccaaaaaaatcagaagtattaagattaaaagggagctttgctgagaggccaacaataccttaatgggcatcataatataaaggaagaatgtaataaaataaagatgctctaacaacttttaaatatattctaaagcctaatttgcaaaatcaatattgtagaaaattaatcagtggtttgaagaacagctttaagaagctcatttattcaaaaatgtgtaaaaactattttaaaactgctgtcttgcactgttcatgattttgccaaaaaaaatgatgaaaatattatggcccctgatcatacagcatgtagttataatggagagtaaccagataagagacaatgaattttggtgagtatttagatgaataaaatacatatactatgagaatatagacaatgggtctttaactcaaacttgataagtcattaaatcatattttctgaggctaaaattgtgaacacacaagatcaggtgtattgagggccaaggtttggacagaatgaagtgatttatgtagacagagggaatacatgtacagaaatccttgaagatcaaataattttactttcaggaatatgaaaatagttcagtctgaatggaagtataccctgtacttggataagaaaatgttaaagattaaaaggagtaagcaatggctgcatcatctatgaacttcagaaacattccaagttgttcatactttattctgaggacaatgggaagaagtgcaaattagtgatataataaatggatttgcatgagaattaccttatatgtcacataaaaaccctttagaatgtttctttttgagcttttctcatatcattaaataacctctaataataaccagttttatccagttttccctatatttattgtccataccactattcacctgttggacaattccaatagattcattcctaatattggcccatcacatattctgtgtttttggtgtacaacattctagtctagcccaacatttatgagcttagagggacactatgttcactgaaataagtcaagtacagaaaaacaaatactttatgttctccctcatactggcagctaaaaaagttgatcccatagaagtagaggagtagaatagtagtaccaatgactggaaagggtagagaatatgaggggatagagaaagtttggttaatgggtacaatattacagttaggagcaataaatatagtgccctataacactaggattaacaaaaatttgttttatattttaaaacaactaaatgagagattttgaattttctcaacacaaagacatgataaatgtttgaagtaatggatatgccaattgccatcttggcatttgatcattacacgtttgggcatttgatcattacacactgttgcatgtgtcaaaataccacacatacctcataaatatgtaaaattattatgtgtccattaaaaataaagataaatttactattaaataataattaataatcacataacacaatgatttcattatataattaatgataataattaaaagctctgatacaagtggttatataaaaatatttaatttaaaaattacattaaaaacactacgcaaattaaaggcaaatcataaacaagaaatagtgtttgcaatatcaatatcaaggagtcaaagtgttatatacagatgctttttataataatcatatatatatttatgatatatatacattacatattgcctgaataataatctggatttttggactaccttgtcattaaagtttctatgttcttttctctagtttcctaattgtcttcactgaacatgttacttccaatatataatataatacatgttattaaagttaaaaataatatattaggtgctttctaaaaacaatatttccaacaattatggacagagagatggattggatgaatatggaatgtaaaacagcaagacttgcatttatttgcctaatgttactatattaagtatatccgtaggcttcaatagcctggggtacagtttagctacaagataataataaaccccttaatacctgggaatgcctaggaagcacgactttcctcaaaggctgacactcctcttagttttgaggtcaccatgtggtgttttatatgcacctgccatagatagttgagcagtgtcagagtagctggccaaggatgtctcattcacttccatgttaaatgcctgcctggatatgatgccttcaagagcaaatgctccattcttaaaaccaatggctgttcttgcactttgataataactttatactataatataaactataatataaatacataacttaatatgtacatgtaaactaacactacaacactgaacattgaaataatcaccacataagtcaaaaatagtgtatctcttttacctcagaaatgcatcttatgctacctgacaacttagctctcaaagattttctaaaagtttttcttttttcctaaaagttttatagttttacatgtaagtctatgatcaattttcagttaagttctgaagtttagattgaagttcatttctttttttttttttttttttttttttgcctatggatttctaattgctccatttgttaaaaacggcttccctccctccactgaattgcttaataagtaacaagtatattgagcttcctaaaagcacttctgtaattctagttgggaccaagcaaaaggccacaccagtagatttcagcaataacttttgattgtgttagaggaaagtgaaattcaagctgtgcagagttcaggagaggaagaagagaaataaatgttgctcataataatagattggagaagacaggaaacaatttcttgcttttgggaaaggggagtatgtaagatcctgaaaacttgtcccatgtctgttgctctttattattcctattttccattagtaattagcagtaaaatctgacactgaaaagagccaatgttcaatagcctaatggaagaaggaagttagttccatagaaaagataaatacatttaaacttctgtaaattgcaatttaggaaataagaaatgccagtctgagttccagaatgtgacctgggagactacttaaaccctaagaggtctatggagggtttgtaaccatttatagtttactaatctaggtattgttgtttacataatagcatcattgcaaatgtatcattgatattgtaaatgttaaagattattttaaaaattgccaatttttgttgcaatgtactacaaatagaaaaacagctagtgaaaaaacaattatataacagatgtatgtatcttcaatctcacaagaagaaaaatatcacagtgaaagttcatttaaaagattagaaaacttcagaatattaatataaatataaaatttaaaatgcataaatgcatctacatatttaaaatgctaaatggaataatttgatctaatactcccatttgtatgcataaggtttcccaaagtatttcaagttaaaaaaaaaggagataatttaaaatataaaaatatgtttgaatggaatctatgacttttagttatgcgatttttttattagactgtgaaacattcagttaatataaattaaagattgccagagatatctgcatgtaaaagaggaatcatacatttgtaatggaagtagcacaagtgcaataaatgtacttatagagtcaatacttggagttttttaataaaaggtagaacttaccatatgtgaaatatattcaagatagaagtgttaaattatgaagtattatttattaatttctgaacattaacaaataaaaacgatggcaaagtactcctttcaaatgtctgtttttctgtaaagagacatacaattatacatcaagctattaattatataaggaactctaaaaatgtactactataatacctgttgataacacaaatgttttccaatattttaaacattatttgtaggactttggttctgatcaagatggaatagcccaattctttccatattctccctcttacaactaaaaagccctgacaaacaacacaaacaagaagaataagactttcaccagtagaaagaaaaaagcagactgcctaggaacttcaggacttgatcaatgacatgtgtattagtctgttcctacattgctataaagaagtacctgagactgggtaatttataaaaagatgtttaactggcttatggttctgcaggatgtacaggaagcatgctgctggcatctgctcggcttctggggaggcctcaagaaacttacaaacagagtggaaggcaaatgtggtgcaggcacatcaaatgatcagagtaggaacaagagagtgaggcggaaggtgctatatacatttaaaccaccagatctcacaagaactcactattgggaggacagtaccaagaaggatggtgctaaatcattcacgagaaatctgcccccgttatctaatcacaacctaccaggccctacctccaacagtggagattatatttcaaaatgagatttgggcagggacatacatccaaactatatcaacatggcagtgagttccctgggttttcgtatttcttcccatatataccagataaggcctcccatgtataccacaggagactccaaaaccaccactaacaggcacagattaaaaaaaaaaaactctaagaaaagcctattcttcctaatcaatgcaccagacaaagggtggcctaacacaacagaaaacattcgggcaatacgtattctattctaccccaacacaaatgaataaatcgctcccattctatggcttcacccgggaaagtgggacacggatattctactgccacaaaccccactccatgaaaacaggaagtggcactctcatttcccccacttgggtggtgttgacagagcatgcaggaagctgatctgtccccagcacagcagaagcaaacagtgttctgattcttccatgttggtaaagctgagcctctatcctcacttagcagaaaggacttaatgagacagtgtgaggtgcagctaatgaataattaacttcccttcacttccccttctccagctgttagtgggacctagcagagagccccactcaaatagtcccagctgagtttttaaagtgaccaaagcaatctaatggagagccattttaacaaacagagcaactggaaatccatggaccaaaaatcttgatctaaatctcagatgtcaacccgaaatttaccataaacttaaatgtaaatctctaaacattttagaaaataaatagaaaatacatttaagatccaaggtcaaataaagctcttaaacttgacaccaaatgggatgtgcataaaagaaatgataaatttgacctcatcaagatacaaaaatttgttctcttaaaaagaccagtgaaggagatgaaaagccaagctacagacagaaagaaaaatttgcaaactatatatttgacaaaggactagtatcataatataaagaactctaaaaactcaataagaaaaccagagaatccaattagaaaatgagtgaatgatatgtgcagacatttcattgaaaacgacatttagatgaaaataagcacatgaaaagatattcaacaccattaactaatggggaaaggcaaatttaaaccacagtgagatatcatcacacacttacctggctaaaaatagtgaaaacactaaatgctggaaaggatgttgagaagatagactactcatacattgcccatgggaataaaagtggtacatgcaccctggatgacagtttggccatttctcaatataaaatgattcaataaaaagtaataaataaaataaaattatttttaaaatactatatctgggtaaaataagtagagaagaactttctattagttatctgagcattaaaaatatatgaacagaatatgcatatttatatattttaatcagtttcttgtcgatatattttctaatagacaactttttatttcaatatagaaatttttcttagaatcacctgtaaaattttctaaaagttgcctattttattaattaaagttgtttactaaaaataaaaaaaacttattacatggctactgtaattggcttatagacatgtagatcaataggacaaaacagagttcagaaacaaacttcacataaatagaaaattgacttttgtcaaatgctccaagatattctgataggtaatagaaaatcattttcaacaaattctgcttgaactactgtatatccacatggggaaaacaaattacatttacaagcctgttataccataaacaaatatctgggatagatcaaagacatacacataaaatctaaatgtgcatgtccttttgagatgacatagaaaaatatcttcttaatcttatagaaaaaaatttcattgagagtgagaagataccaaacatagaataataaacagaaaattatcttcaccaaaattaaatgctttgctcattaaaaacaccaagaaaataaaaatgcaagtcatagactcaggaaaaatattctcagtacatgaatctcaaaaggacttgaatccataatatataagaacttttggaaatcaacttaaaaggaaatatgggccaggtgtggtggctcacacctgtaacctcagtgctttgtgagtctggggcagaagggttgcttgaggtcaggagttcaagaccagcctgggcaacagagagagaccctgtctctacaaatattttttttaattagttgggtgaggtggcatgtacctgtagttccagctgctagggaagctgaggcaagaggattccatgagcccaggagttggaggctgcaacaagctgtgatcccagcactggatctggctttgtgatacagcaagacactgtctctataaacaaataaatatataagtaagtaaataaataaataaaaataggagatatgaatgcatactttacaaagaagtagttggtaatgcatagtttctttttcaggagtttacccatagtaaatgaagaattatgtcatatcaaatacttgtatgtgaatggagaaatatgtgagaatatgcacaactatgtacttatgtttgtagcaatttcacttacaataccctaaatatggaaactatctaaatattgcctcaatggtagaaggaagaaccaatcttaatgtgggaaaagaattaacaagtaccaaaaccaataataatagaagaaaaaattatcaattggagctttttgaaaattaaaatttctacatttttctgatacatattaatgttgaacatctttttacacattaattagccacatcaatagataacagggaaatgcaaattagaagcaaaattaaatagtactttacatccaaaaaaaagagtatttggaaaacccgaaattcctaaatttctgctgggaatgtaaaatggcatgaatactttggaaaccagtttgacaaatttttgtaaaattaaacccacgacccattagtttctctcttagatatttactcatgttaaataaaaaatgaaaacttatgtccacagaaagacttgtatgaatattcatagcaacttaactcatgataccccaaactaaacatcaaaatattccataacaggataagaaatctatggcccattattacagtggaatacaacatagctttagaaacaaactactcatacatttaataacatcaataaatctcaaaattagtacattgagcaaaagccatacattaacatatgcatatacatatatatatacatttacataaaaggtacacactgaatggttcttttattgaaagattaagatgaagcaaaagtattcttttttttttctttttgagataggatctcactctctcactctgttacccaggctggagtgcaatggcctgatcacagctcactgcagcctcaatcttctgggctcaagccattgtcccacctcagcctttcaagtagctggaactacaggcacatgccaccatggctgtagagacgaagtcttcctatgttgcctaggctggactcaaactcatggcctcaagtaatcctcctgccttgacctcccaaactactgggattacaggtgtgagccaccacacccagcctatactgtaaatgtttttgcttttatagagacagggtctccctatgttgcccaggttggtctcaaactcccaggctcaagcaatcctcccaccatggcctgtcaaagttctgagattatatgtgtgagccaccatacccagccttctatgattattgaaatcagaacagtgattgcctttgggagtgaagactaactggaaagaagcataaagatactctctgcactaatagaaatgttctatatcttgattagatagctgattactcacaaaactctacgaagatttgtatattttatgtaaattatgccttgatgaataaaaaacattattgaaaatgctgttaccttgtgacatttcaagggttttgtaagttgtgtaatttcttttctcattctatatttggcttgtactacttttgtgattgtaattttaggtttattttctgaaagatgggcttcctgactatatacatttcagaccccgaaagatggatgcacagtggagtgatttttttctacagttatgcttctctcaactcaaagtcactattgagggcttttttcttcttatccctattcctcaatttctaccactatcacatttatcttctttatctaatgaagtcactttatttaatgaaactttatttaataatccagaaaaatttatgttccatttctttattttttttttttttgacggagtctcactctgctgcccaggctggagcacagtggcgtgatctcggctgactgcaacctatgcctcccggattcaagtgattctcctgcctcagtctcccaagtagctgggattacaggtgcccaccaccatacccacctaattttttgtatttttagtagagacggggtttcactgtgttagccaggatgatctcgatctcctgacctcgtgatctgcctcggcctcccaaagtgctggaattacaggcgtgagccaccgcacccggccccacccagctaatttttgtactttcagtagagacagggtttcaccatgttggccaggctggtcttgaacccctcacctcaactgatgcatccatctcagcctcccaaagtgctgggattacaggcgtgagccaccacacccagccctcagttatttttcttatatttccttcatatatcaatttttaaagcatgaccataattatacatattaaccactctgtctcttccactatagtgtagattcttcaaggaaaggaaccatctcttctttctcctttggtactatcaagcaacatcttcgacatctacttcatctactggaagaaacctcccacgttctccagagttgtcaaccatgtaccaggatatgatgcaaatataaagggatcattgcttttatcttgtcctcttacagtcaaatgtccagaattaacatctacgtttgtggctcctcaaaacaacttagattcacaattcatggattgctttatgaatttattcacaaaattgagactgaaaggaaagtaaaaattcaccatgcaaggccaggcgtggtggctcacacctgtaatcccagcacatcgggaggctgaggcgggcagatcacgaggtcaggagtttgagaccagcctggctaacatggcaaaactctgtctctactaaaaatacaaaaattagccaggcgtggtagcacatgcctgcaatcccagctattagggaagctgaggcaggagaattgcttgaactcagagggcagaggttgcagtgagccgagatcaagtcactggattccagcctaggcaacagagcgaggctccatctcaaaaaaaaaaaaaaaaaaaaagatacaggaaattgtttgtgtaaaggctaaaaataataataagaaagtcggtttgaaaagctgaacatgggctgggcgtggtggctcacgcctgtaatcccaggactttgggaggctgaggcaggtggatcacctgaggtcaggaattcgagaccagcctggccaacatggtgaaaccacgcctctactaaaaatacaaaaattagctgggcgtggtggtgcacccctgtaatcccagctcctcagaaggctgaggcaggagaatcacttgaacccaggaggcagaggttgcagtgagccaacatcacgccactgcactccagcctggctgacaacattgccccggggggggccttgttcccagagctcccaagatggtggcgggccgcttccaagatggtggcaagcctcttgttctctgacctggggttcttggcctcacggattccaaggaatgaaatcttgggccatgcgatgagtgttatagctctattagaagctgtgggtcacagaagagaaccacggaaagtggtgactagtgttcagcacgattaggacaaatccgggcacttagccatgcaggaacaatggcaagccttttaccggatcgggagcggcaatgggtgcctcactggatcaggagcacaggggacaccctgctggatccggagggatggaagtcagcggcaggtctgtgatggcagccaacagcagtggtggacggcgagcgaaagctcagctcgagaggtaacaaacatggaccagaagagtgtgcagttgcaagatttaatagagtgaaaacagagctcccatacaaagggaggggacccaaagagggtagccgttgacatctcgaatgcctaggtttatatcccaatcactgtccctcccgctgtgctctcaggggatagatgattagctatctctttacctcctgtttttgccaaattagcattttagggagctctctttactacctgattggtcgggtgtgagctaagttgcaagccctgtgtttaaatgtggatgcagtcaccttcccagctaggcttagggattcttagttggcctaggaaatccagctagtcctgtctctcaacacggtgagactccagctcaaaaaaaagctaatcattatttgtcatggctaaaaagtagatagtacttggtagagaagtgagaaattatagtcagggcattagtggccttatatacatcagcaagtagtttagatattatcctggggattttctttcagtatattagtactagttaatcaaaaaatattagctatatatacagcaaataatttatctctgcctccatagaactcaccattaatggaaaagacagataataaagaaaaaattaaaatataataaaatgatgttaagcatatagctacagcggaaaaaatatttataacatttaatgaatacagttatgttaccctgtgcttaagcatcaaaaaataccctttgttttctttgctcagccttgttttccaagcatctattacagtgcctgacacgtaacaaacaggcaacaatttttttcatggataagcaaatcaataattgaattgaactttatggaatgaatgtgagttaattaaacagacagtggataggcatttagccaggagtgagaagcctgcatgtatgaaaacctaggacattgagagagtgtcgtatgttcaagaacccgaaagaagccccagagagctgagtggagaaagcaatatgtagaatactaggagctaggcctggagagggagataaaatctgtcccatacacagtatataatctattttaaagattttgaaagtttttttaaggtgatgagaagttaccaatctatttgtgttaggggaattacgacatcattttaccactttaaaagataggtttggccaggcatggtggctcatgcctataatcccagcactttgggaggcagaggcaggtggatcacctgagtgtgggagttcgagattagcctgacgaacacggagaaaccctgtctctactaaaattacaaaattagtcaggcgtggtggcacatgcccgtaatcccagctactcgggaggctgaggcaggaaaatcgcttgaactcgggaggcagaggtttcggtgagccgagatcgcgccattgcactccagcctgggcaacaagagtgagactccatctcaaaaaaaaaaaagaaggtagttttataaagaactggtgccatggaaaaattaataataagaagataatttttgcattattatggagaccatttgtgatgactgggaagtaaacagatgtaaagataacagttagaagtctctttgtgcagtttaggaaagaaattattgaagttgggacttgggggatggcaatgaggatgggaaacagtggatacactgaggattttttttaggaagtaggaacaaacagaccttaacattgctgagtgagtgaaatttgaaaggagccaaggaaacaaacgtcttcatatattgagcaattaggtgagtagaggtttagcagagctgcagaagaatatgcagatttcaaatatgttcttttgagattgccatgggatgtcaaggtagattgtttggagaactgtacataaatactctagaaaccatgtgaatcacagaaatagattagggaatatgatggtgattcgttttctgaaaggaaatgagttgtcccaggaaaagagatagagatataaaagaaaaggactgagaataaagtcccatgaagtttccatatttaataaatagaactttgtggaggaaaagttaaatattaaatatgaactcaatcgaacatggacacaatggtcaccaagtcctggaacaggttgtgtgagccccttgaagcgttcatccagcactgttttggaaaaatctctctttcaatctattcctatacgttagtttttgaaaaacaatagacaatccccaaaacaagttgacctctttgtgttccttgagcccagttgcagagggccttcatgactgggcctcatgccaaacaacttgttacaaaaagagctaggtcccagactgcacagaagcttcatgagacctctcctcatcttgcatggaggagtggcccactctggagcccaggctgttgcttcccagtctggtggtgaatcctccatagtttggtgaatgtaaatctcttttcccttctccccttcccattgcaatttgcttaatatatcaatctgcttattatatcaaattgcttattatgtcatttgcttattatatcaatttgcttattatattaatttgcttattatatctgcattgccatttatgtgggataaagcttgtttacccttaaaggtattgtgtgtgtgccttttcttttcccctcacacgtctccctcacaaaataaaccttagaagcacaattgtgaaaaatagaaaacacaggggtgtcagaaatattaggggactaaaatgtttctgggagagagggatgaaagttctttaagttaaaaagtgctggcaaggcatgatggctcaagcctgtaatcccaggactttgggagaccgaggcgggcggatcacctgaggtcgggagtttgagaccagcctgaccaacatggagaaaccctgtctctactaaaaatacaaaattagttgggcgtggtggcacacgcctgtaatcccagctactggggaggctgaggcaggagaattgcttgaacccaggaggcagaggttgcagtgagctgagatcccaccattgcacttcagcccaagccaacaacagagagtctctgtctaaaacaacaaaaaaaaggctaaacctggcttggtactgtggctcatgcctgtaatcctagcactttgggaggctgaggcaggaagatcgcttgagtataggaattccaggctaccctgggcaaaatagtgagacttcatctctacaaaaaaacaaaaaaattagctgggtgtggaggagtatgcctgtggtttcagctactcaagaggctgaagcaagaaaattacttgagcctcaggaggttgaggctgcagtgagccatgatcacgtcactgagctcagcttgggcagcagagtgagatctgctttcaaaataaataaataaaaataaagacaaagattaaattaaattaaaattaatagtgttaaacctcactctaggcagaagatatctgtcaggtgactggttgtatacattaaacaaagaactttatggtaaaacctccagaggaaacccagaccttgtgtgttgccatatacaataaccatgcaatatttgctactcttggtcttgcaaaaaaaaaacaaacattagctgtgattatgagtctttcatgtgacatagtctctcatatttgaacagtattgaggtagtctgtaaatatgtcaaactggatcttttttttttttttttttttgagacagagtctcactctgtcgcccaggctggagtgcagtggcgcgatcttggctcactgcaagctccatctcccgggttcatgccattctcctgcctcagcctcccaagtagctgggactacaggcacctgccaccacgcccggctaattttttgtatttttagtacagatgggttttcaccgtgttagccaggatggtctcgatctcctgacctagtgatccgcccgcctcagcctcccaaagtgctgggattacaggcgtgagccaccatccctggcccaaactggatcttttatctcaccttttggaaacaaattacccacttttatgagttatataaatataaataataatatatttatatattatattatatataattaaatatatattaaaatatatatatttatatattttatataaatataaataatattattaataataatacaaaaatgtattattttaatctgataaaacatttctattgtttaaaatttggcaaataaaagtttgagaaagaaaaaatgcacgtacagcacagcacccaatgaaaactattattaatatatttatatatatatttaaaagtgttcattacacacatgcaattgatatagtcatacaatgtgtatgcatgcatagaatcaatatcataatgtagaatatatttcataaccagtatttaggaatctttgaatgtctcaaggttttactgataaacaatgaaactgaatttttagcattcatagcatgaagatgggaatcatgatactccccttgcatcaaccattatagtgaataatgagtcttcaataaattttactaactggttgattgccagcaataataacaataataataaattacttttcactgacagaataagccaaaacaatagtgtggtgttagtgtttttcagcccttttttgctctccaacattaagcagtttggaatgaaatagatacacaaagacacgacacacacatattaattggatgttcttgtgtaaccatgctcctatataaaagttgattttagtcaatcttcttttttagtaaacttatttttattttgtattgtgtctgttttctatactacttataagttcagttaggaagttctatgttatttcttcaggaataaatttactaaaaccatcaggaattgtctacagataaattaagttttaatggaaaagtgaagagcaagaaagaacgcatacagatgtaagggaaagaatggaatccgtctatttttaccacgttagtgatctggagcaaaacttccattttaaatagataatgcaagtgtaaacaaagcacagatagtatccagacagcagtgatcaggaggatgttgcttctcagcacaaagcttcatcaatgttaaaatgctgcttctttccagtagggaaatgtggagctttgtttgccgtaagaaatgtgaagactacatatgctcgcccttgtaaaaacaggtcaggtttcaaagaagacatttttatgcttaaagttacaagacaaacaattctcatcggcattggtttgtttatttaattttagtcttagttacattttctacaagtgaaatttgaaagatttgtgggactagctacaggcagaagtcatcatggctaatgcaactccattctagcaaaagctgtttctcattgggcatgaggttaaagtaaaacaaacaaaaaaacaaaactgtaatacataagatatgactgttatgggactggaacagaaattcttatgctatcctgtgccttttcagttccttgtcctctaagcatcattggcaaattgagcctgtaccaattcatgtattgaccctataaatgatgatagtggttttggcaattctttcttgactcatcaaaaagggaaattaatagacaatgttaatttactgctgacttttcttattagatcaatgagatgaagagtctacccagcacccaagagagtgtttgaaacataataagcactctatacatatttgttatttaaaataattagtagctattatgattaaggacattttctttttttttttttttggatcttatctatgcagttaacacttataaacatacagaattagtttttggagcaagaaaccagtgtattggggtatggcagagaacatctgtgtgtacaaaaacttaatggaaggtgtcttagtttgttcagcttgctataatgaattcttagactgggtaatatataagcaacagaaatttatttctcacagttctggagggtgtgaagtccaagattaagttaccagcagattcagtatctgataaggggtggctctctgctccatagatagtgttttgctgctgtgtcctcacatgatggaaaggaactagcaggctccctcaagcctcttgataaatgcactaatcctattcatgagggctctgccttcatgacttaatgacctcctgaaggcctcacctcttaataccatgtccttgggagttaggcttcaatatatgaaatttggagggacaccagcattcaaacattcagcaaaaggtgttttgtcttcatgaagcttttcctctatgtcattccatcggctctccatgttctgacacaactacagttcctatctttaaaatgttcccactagggcaatctctctataattaatgcaaatgtataatcatccatctattcccttttaaagcaattaaagctcctaataggtttttctaagactttgagataaaacagaaaatttttttaaaggatgttttttccaattctgtgaagaaagtctttggtagcttgatggtatggcactgaatctataaattaccttgggcagtatggccattttcacgatattgattcttcctatccatgagtacagaatgttcttccatttgtttgtatcctcttttatttcattgagcagtggattgtagttctccttaaagacgtccttcacgtcccttgtcagttgtattactaggtattttattctctttgaagcaattgtgaatgggagttcactcatgatttggctctctgtttgtctgttattggtgtataagaatgcttgtgatttttgcacattcattttgtatcctgagactttgcccaagttgcttatcagcttaaggagatttggggctgagatgatggggttttctaaatatacaatcatgtcatctgcaaacagggacgatttgacttcctcttttcctaaatgaataccttttatttctttctcctgcctgactacgctggccagaacttccaacactatgttgaataggagtggtgagagagagcatccctgtcttgtgccagttttcaaagggaatgcttccagtttttgcccattcagtatgatattggctgtgggtttgtcataaatagctcttattattttgagatacgtcccatcaatacctaatttattgagagtttttagcatgaagcactactgagttttgtcaaaggccttttctgcatctattgagataatcatgtgttttttgtctttggttctgtttatatgctgcattacatttattgatttgcgtatgttgaaccagccttgcatcccagggatgaagcccacttgatcatggtggataagctttttgatgtgttgctggattcagtttgccagtattatattgaggatttttgcatcgacgttcatcagggatattggtctaaaattctcttttttggttgtgtctctgccaggctttggtatgaggatggtgctggcctcataaaatgagttagggaggattccctctttttctattgattggaatagtttcagaaggaagggtaccaactcctccttgtacctctggtagaattcagctgtgaatccgtctggtcctggactttttttggttggtaggctattaattattgcctcaatttcagagcctgttattggtctattcaggaattcaacttcttccctgaaccaaaaaagagcctgcattgccaagacaatcctaaaccaaaagaacaaagctggaggcatcacgctacctaactatcctacaaggctacagtaaccaaaacagcatggtactggtaccaaaacagagatatagatcaatggaacagaacagagccctcagaaataataccacacatctacaaccatctgacctttgacgaacctgacaaaaacaagaaatggggaaaggattccctatttaataaatggtgctgggaaaactggctagtcatatgtagaaagctgaaactggatcccttccttacaccttatacaaaaattatttcaagatggattaaagacttaaatgttagacctaaaaccataaaaaccctagaagaaaacctaggcaatacattcaggacataggcatgggcaaggacttcatgtctaaaacaccaaaagcaatggcaacaaaagccaaaattgacaaatgggatctaattaaactaaagagcttctgcatagcaaaataaactaccatcagagtgaacaggcaacctacagaatgggagaaaatttttgcaatctactcatctgacaaagggctaatatccagaatctacaaacaactcaaacaaatttacaagaaaaaaacaaacaaccccatcaaaaagtaggcaaaagatatgaacagactcttctcaaatgaagacatttatgcagccaccagacacctgaaaaaatgctcatcatcactggccatcagagaaatgcaaatcaaaaccacaatgagataccatctcacaccagttagaatggtgatcattaaaaagtcaggaaacaacaggtgctggagaggatgtggagaaataggaacacttttacactgttggtgggactgtaaactagttcaaccattgtggaacacagtgtggcaattcctcagggatctagaactagaaataccatttgaccccgccatcccattactgggtagatacccaaaggattataaatcatgctgctataaagacacaggcacacgtatgtttactgcagcactattcataataataaagacttggaaccaagccaaatgtccaacaatgatagactggattaagaaaatgtggcacatatacaccatggaatactatgcagccataacaaaggatgagttcatgtcctttttagggacgtggatgaagctggaaaccgtcattctcagcaaactatcacaaggacaaaaaaccaaacaccacatgttcccactcataggtgggaattgaacagtgagaacacttggacacaggaaggggaacatcacacactggggcctgtcgtgcggttggggaacgggggagggattgcattaggagataaacctaatgtaaatgacgagttaatgggtgcagcacaccaacatggcacatgtatgcatatgtaacaaacctgcacgttgtgcacatgtaccctagaacttaaagtataataaaaaaattaaattaaattaaatttttaaaaaaggatgttataagatagagtcctatgtccaagaaatgctaactttaaacagactcgcagtctgtacccattttttgtgtgtgatttttctactctcagacttctaatgtgtctaagattccgttttattatataaaaagtgaagttatcgcactggacgatttctggactcacttctcagctataaaaataatctaaaattacttacataaatataaattttaaaaagtctttctctaaagatctttgacaataacatggtttaagcataacctttcctggaaaaaaagaagagagttaaaaatatctaattcttggctagacacagtggctcacgtctgtaatcccagcacttcgggaggcagaggtgggcacatcacgaggtcaggagttcaagaccagcctgaccaatatggtgacaccccatctctactaagagtacaaaaatgagccaggtgtggtggcgtgcgcctctagtcccagctactcgggagcctgaggcagaagaatcgcttgaacctgggaggcggaggttgcagtgagccgagatcgtgccactgcactccagcctgggcaacacagtgatacttcatctcaaaaaaaaaaaaaaaaaaaaaaaaaaagaatctaatttttagggctccttttaaatagaaattcttattattacggtttcaggagatggacactgatgtttgctttaagccctgtggagtaacattcatgacattcatgtaaaatagcagtcataattctaatagaaaaataagagctaccactagtttttattttgttaatggactagaatgctgctctaagtaaaacattctgtgacgaaatatagttcagactttttcaatccatgcctctacaattcaataagcataccaagtaaaaacaaatatacctttaatttttctctaacccttggtaatttcttttttatattccataggttcaaagcctttggcaagcaataacatcaacctgaaatttaataacattgtttgtactgattgtgtttattcttacagttaccttcctttaacgacaagtgataccttctccccattcataacggtgatataaatgtttcttctagagtagatttaggcaaaagaaagtaaattgattttaaacataataaatgattaaaagtataggtcacatgtggataaaataaaaatagtgaaagtgataattagatgtctgaagattttgaaagcatagacttagaagtagatgtgatttatttgcagctctcctgatcacgtctgatgtcttagataatcataataaccttatctcacttgcttccaatatgatttgcttgccaatatcctataaaaaaagtctcattcagggagaaccaagtgtgtgtctggttatatgttcaattttagaatttactatttaatgatggtttttgtctggatcaaatgaaaatcagagatttctgacttaaccagtgtctgtaaatgggcaaaccagttcagattctgtctttgacaacctgccaaaatttctttatacttgaaagatatctggagcaagatatgtatttctctatatgtattatcttatactaaggacagataggtaaggttgtataatccccctcttttggtagcaattgtaaaacacctatcaatattgtaaattgacataggttttttcctcaaaattctgctgtagaaatttagtctaccagaaaaactactgcaagtgatctatgatatagatgcaagaatatttatttaagcattattcatataataataattggagtttaagcaaatttccttattttctatgcttggtttcaaggatacttcatttattcttctggttttccttctaactcttgagccactgcttccagacctggctgtttctcttcatcaccttgaactgttaatagtcgagtgcttcagggctagcttctttcaactttttcttgatctaccctttatgccttggtattttatccaatattaaggttttaaatagcctttaaacattgataatttgcctcattctttctcttgttccttttctctaaaatcaagacatatttcattttgatactaagagtggttccagagaaacggaattttaaagatgacttttctaagttggctttggggtttctgggattggctttttaatctttttagatttgaataggctgatgactctatttccagtagtaaaaagaccgctggtggtccatcgtgagcaactatttatggagattcagttataataggtagctcaggtcacatggttacttacacagcgcaaagtcaagcattctgtctttactaaggtccagtatcaaggccgaggaccatctttaaaaaaaaaaaagttatttgaagaaggttgcaagtccttgctccgaaaacctaaaggtctgcactgtgattcagctatagcggcctgccataggttctaaacagcatctttatctaccatggacacctgaagcacccttggatttgttgaatcatacgctccaaggggcagaccagcttacacagaatactggacctgctacagagccttccggtattctgggacctactcaaaactatcagattttcagtatacacaactgagtgaattgtctccaaaatccatactggcccactagatgttgtgtatctttcttgattgtattaggagccagatgcaaaaacttatctctcacttaattttccccaaatgttcaaaaatatccttgcttcttataagaggttgattacaaattatccaatgccgatatttcgtatacagggaacattttccttcacaactgacctccagggatgtcctagaggtgagcagtagtgctacagctgtccacttttgggtgttacctgcatattctgcaaaactgtatgtaaaccatgaccaggtcttctctttctctgtcaactgatcgtaggaaactcctcatgatgccataggtgagcgtttggagaaatgaggcagtgtagcaagagtgggtaccatgggcatttgggcctcttcctaatgaaacttacttgtgccttcaggggctgttcaggccctatcacacacataccacttccatttgataatggagtgtgctatgcactccccactttatgaatttgtgggttaggtataggcataactttgggcagggaacctggttgtatactttgcttgggaggagaaatgaccagacatgggattgtgtactgattcatgggctgtagtcaaagtttggctggatgatcagggacttgaaagtaacattaaaagaaaattggtgacaaagaaattgagtgaaaaggtatatggatagatgtctcggaatgggggaaaaaacatgaagatatttgtgtcccgtttgattgttcacaaaaggatgtctcagcagaggaggattttaataatcacatggatagaatgatccattctgtggaaaccaatcagcttctttcctcagtcactcatcactgcccagtgggctcataagtaaagtggccatggtggcagcattgactcagcaacatgaatttctactcacctaggctaatctggctttggtcagtgctgagtgcccatatgccagcagtagacaccaacactgagctcctgacataacatcattccctgaggtggtcatccaggtatctagtggtaggttgattacactggacaacttccatcctggaagaagtgaaattttgtcctttctggaataaacacttactctgaatatggatttgcattctttgcatgcaaggcttcttccaaaacaatcagttgtagatttacagaacaccttccccaccaccacagtattccacagagcattgcttcttaccaagaacacattttacagccaatgaagtgcagcaataggcccatgctcatagaattcactagtcttactgtctccactatcccaaagcaactggctgaatagatgatggaacggccttttgaagattcagctgtaggatcaactagttggtgataccttgcgggttaaggcaaaaagattccttagaatatctcttagtattgccatgctctgtgattaaggtcaacggaaaattacagcaacccaattcagtgaggactacaaataaccaactatcagaaataatagcaaaaggaacacagaatggggagtagaaaagtgtagttttaaatgttagctacaatcacatgagcagttaaggaaataaaactataatcgtgatgggcatttctttcttattttgttatgaatatattgtgtgtatatacatgtatattaagtaaatgtttttgttctttcctctcttactcctttaactagtaacataagatgtattaattttatatcatcatttgagtattggtaattttaggtcatgtgtttaagttacaggagaataccaggagaagggtaaaggtcttcaaagacttcatcaactcttctgaagagattagtacatgtctgggtgtaagcgggatgatcctaacatgttagggagaattatgtgcttgctttatttagagattaagtatggtttaaggagatacatatgaatgccaagctgacaagcagtggacttgtgatggttaattttatgcttcaacttgactgggctaagagatgcccaaatagctggtacaactatttcggggtgtgtctgtaagggggcttctggaagagattagtatttgactaatctaatcagtggactgaataaagaagatccactctcatcaatgtggacaggcatcacccatccactggaggccaggataggacaaaagggtaaaagaatggtaaattttctctctgttcttgagctgagacatccatcctcttctgccctcagacaccagagctccttgttcttgggcttttgaactccaggacttacataataacacctcccctgtctgacccatggcctacccttcccagttctcaggcctttggcgttgaactaggatgtacaacatcagcttccctacttcttaggcctttggactcagactgaatgacaccagaggttttcctggtcctccactttgcagatggtatgtcatgggacttctcagcctccataattacatgagccaattctcagactagatcttctcttacatatctctatatatcctattggttctgtttctctggagacgtttgactaatataatatctaactgattactttccatatccacttgcctatctaatatacatctcaaatttaacgtgtttaaaccgagctcttgattttatagcctcctccaatcctcctagcatagtaactgcattacaccaaggtaaataaatcatattttaccacattttttcaatccgctgccacatcaactctgtcataaaatcctatttgttctaccttcaaattattccacaataaaacaaaacccatttcagcaccatcatatataaattgaagtgttgaacgctttccctttgagatcagaaacaagatatggttttttgttattgtttccattcttagcagctctttaagccaggaacaagaaataagaggaaaaagaattgcagataaggttcctatatacatagaaactcctaaataaactgctaataaattactagaatttacaacagagttaatctaggttactgaattcaaagcccatttattcctatatgctaagaacaaagttagaaaaaaaaccatttacattaaaagtaaataagtacctaacagtaaatcaaacagaagatgtgcaagtttgctttacagaaaagcttgttagatgcagtaaagaagatccaaatatttaatattataaagatgtcatttctttccatttcaatatatagacacattgaaacaccacataaaatcacaagaatacaaaaggccaaattagtcgagacacttaaataaaattataagaacttctagatagcaatacttattgcaaagcttttatacttcacacagatcataagagaatagttctggcatagatggacaccccatgtgtttcaggatctacatacaagcttgttcacagcgtcactgaacatgggcagctacccaagtgtactaaccatgttgtccactatcccagagcaactggcttgacagacgatagaatagataagaatggatgaatacttctagcatatttatagaatggtgtatagtctcaaacaatgtttacctacagaaaatggaaaaatgatatataaacatatatagttacacattcaatacagaattcttaccaagagtaagtcaaaaggcttctcctcataatgattttgttttcaatcaccatagtaacaaattaccacaaggttagtggcttaaaacaataaaaagttattgtcttatagatactgagctcagaagtctgaaatcagtttcactgggcaaaaatcaaagtgtcagcaggtttactttctatggctagagaccaccagcatccttagctcatggccccttcatccatcatcaactccagtagcgtagcattttaaaacctctgcctgcttccactgtcatattgtctctatctctctgattatatcaggccttctgagactacattggatctacctgggtaatccaggaaaatctccccttatcaagataacttaatcacacctgcaaagtccttttcgccacaaaacataacatattcataggttccagaaattttaattcaggcatttttcagggggcattatttagtctactgcgatgatacataagattatattggctacaaaagcactgaaatgctatcttattgaagaggaaatttattccaaagcagttgatcaatatttatgtgcaactagcaagaaaaaatatttctgtttaaaattttgcatttcatcatcactaacaaatattaattagcacctcagcaatggagaataaaggagctaactataggttcatgtcagctactggcgtcctttgtgtgagtgataatctcatcaaataccatttctaaaaatttgatatataagatcccttttgtgtttataaaaccttaatgactttttagacccctaccctcaaactctaaccagtaaattttctttatgactttgaaatcccttagtgtagaatttaagaaaaaaataattaaaaaaaaatttttccagacaagtgttctgtataaaggtaaaaatatatttatgaattcactttttacaaaatttccagccgcatttatctatttagtcattaatttcatcatttatataaatatttattggatgcctactatgtatcaggaattatggcagaatctgggaacacaccatggaaaaaggtaacatacttacccttaatttttcacttaagtagcacagcaagtaacggatgaaggtactcttacaataaaaggagaataaaaggagaatgttttatgctaagaattttaacagggatataaacccatcatagcgaaaagagaataaaagaagcccttatttctccctgggtgattcaattaaggcttaaagtggagatgacacattaaggtgataccagaatgtatggatagtagtatgccgctgggcaaggccaagaaagaagttattcctaacacaaagaacagtatgtgctaagtcagcctttctcagctgagaaatgttgtacccagggaacatttatcaatgtctaaagaactaggcaatggctgctgtcacagctggaggaacaggtgctactggcatctagagggtccagaccagagatgctggtaagccttctacaatgcacagaagcactctccacaatgaattagtcaccccagaatgttaatagtgtcacatttgagaaatcttgttctaatttatgcaaaagtgagatagcatatcatgttgtgaaaatcacaagaggcttcatttatggctgctatttattgtgaccatactatatatagtactgtttgagtataacggcaagttgaaatgaagctgggggaatgaagtagggaagctttaaaaaaataattagtgggaaaataataaaaattttcataaggataggaggaaaatgataaaatattatgaataaaatattgtcattaaagaaaatcccttcaaaaaaactatttagccattcagtctaatatacacaggtataacatacccatcctcaaagagtacaatgtagagattatatttagaaaaaaatatgatttatgcagttaccactatggaaagctggcttgattgattattgtattccaaaattagcatctaaaattcttagcgtctgaatatgtattttgtattatgacctattgtattagatttatattattattatttttaaaatatgttttcttttaacatcatatagataatatactttttttttttttttaccaattcctagtaaattatcccacaaaccgaaaggtatttttccgatttgttattctcatcatgtctgtaatcacctctttaggaacccaaaagacaaagtactcaagcgtctgagaatgttcacgaatcaccagatgcaataccagaaacatggtagggtgtttttaattgttttgcatgctgtagaaaagtttcagaagccaagtgaagcctgaaattaaatttgggaactttattatacagtcagccccccaaaactatcagaattgtgtatgtctggacattgcttttgaaaatgcaggaaaaataacctctgttttaatgcacagtcctattggaaagtaacttgtcaattatgctgaatagtgggtgattttcaatgcgtagaaaatggacagggactgaccttagactccttgaagcaatgagctcagttggttgtaaacccagatccttagggtgtcaaggcggctgtattaccctctgcattaagtagcccctgtgtgtttacttttattgatgccctatattgtgctttctcagacagaactcatcagttgcaggttagtgtccttggtgttagaattttagaaaatgtcattgcaatttaggcagcagtgatcaaaagtaactatctcatatcaccaggagccagttctagtttttacactaatccaaaataagtaaagaacatcatgttcaaaggaactattttgtacaagatttgacttttaagtctgatgaatttatgggtaaaaaatattccttttgatctgagttcagtggtttctacctcatatctgaaaagagttagtggaatagataataaattagattgggatgtaaaactgagaaggtacaggataataatttctctaaaagtttactctcaggaaaagtcacattcagaaattgtccagtttccaaaccacagcaaccaggctacagaagggaaaggagtagaaatttgccatttgtagaaatcttcccttttgaaaatcacaattctgtttctttagtcattaggagatctactcggacatctgcgaactagctttcacctcttaattctgattttctgctgaggttttttcttaagtctatataatctctttccctctagacaagccctgcagggctgccaatctcacaagcatccatgctagtctggtgatgtgccactgacagaagtctgaatatttggtttctatggctggaggtatattatgaggttattgactttgttcccttgaggtcaatatcaaaatatattcaaacaagaaatgctgctcaaataaatgtaattttgacaagaaatgaaaatcaatacattatatgtgagtatgtgggtacacatacacactgacatcagtttatatgataaaataaaacaattctgagatgacagtgaagtcgtcgcaccaatacatatatcttttatattttactggaaaaaagcgataatttgataatcttatctgtaaatatttccagctcacttacttcttttattaacaaattatagcaggacctatgtcctcatctaaaaattaaaaccaagatcttccaaatgtcagtaagataagatttaatcaattatttgtggcatcacaagttagtttctgttggacactcatgcctttgaaattgatcttttctgagacatttctcacatactcttaagatttcaatcgctagcaagttctgaaatgtccaaggagtaagtaattgactaacagttttaaacaaacaataagtaatctttaagaactgacgataagtgccctagctcttgttttaaccactttcaaacaagtggttacactgtcacatctcaatgcactgaaattaaatgagaatttctgtatttcttccttgcccttgacccccagctatcagaacaatacctagctgtacgatgaggctgagaaatgtaggcctacttgggcagtgatgtttctgccataattcattttcctgtgaaacatggggaggaggtatcttgttttcacaactagtggtttccactacagaacctgtttttaaaataaacaataatttgatctcttttctctaaaatgccttattccatcaagaagttccatgcaaatatactccccttgaatctgtttcattggttcatcaagattttctaaaataaatcacttaggttccaggcagtcctcctcctataaaaagccaataagagttaaggaacttgggtgcagaaaagtgtgagtcaggggacttgggttggttaagcctccttgctttagcattttgagtttcaattttcctatctacaatgaggttgttacactggataatctctttgccccctttctttgtctaaacttgtaagattcttaacagaatataaggggagaatttgctgtgaaatgaatcaagcctaaaattgagaaaatccttcagcttatacataagggaggatacttgcaatattatatagtcataagatttttctaaactttgcaaaagtaagaaatttttattgcaatcagtaaaatagctgtctctgccacatttccccttgtggtgggagcattggagaaacgaatattttatattagaattattttatatttggatttctttttcttaagggatcctaaaatatgagcctcaggtttcacaaaaactggatccacccctacttatgatgtctatactttccttctttggatagcttaaacataacgagatattaaagtagtttactgtatcataatggtagtaatataaattagaaagaataaccttttaaacgccttccattccaaaagttcttatttgtgcacagaatgttagttgtttcagatcctatgaatcaatatttgtatccaaagagcgtttataatcctaaaaggaactgtaaaaatggagaattgttttcctttggttagtggtctgggttgctgtatctaggaaaatacagtatccatggcaacttgatgttcgacttataacttttgaacactttgctttttttatttacattgttatgatttataatcacactaacgacctcccagttagacatttcctgaccattaatggcaggctttattaaaggcctctagtttcacccgagcctaccaatagtttcaattggttattaatgccaagaacatatccagtgtgaaggtcattatggcttaaataatgccttagaaagttatgcaaggctagcaattaggttggcttttaaacgattttagaaagtctatctaaacactactatcagaaaaaaataataataataaaagcccagccactgatgaaactgaagaaaatgttaaaacaattctttccaggttgttgagtttttaaaaatagctttgagactttaatgatctgcgagttatatatggtctggaattattaacttgcttactcttccttagtctcccattaagattccacccactctttttggaactgtctgccccagaatgtattacctgctgtgttaattaccttgcaaagtcaagggtatcactggcctgtttatgttaattgcccttggtggttttacaagtgagaaggagaagagagccaaaaattaatgtggaaagctcttgagttctactgtgaacaatcaattggacccatgttttaaaattttgagtcatttaatttttttttttttttttactgtacaccatgcatgcatatattatatgtgcatacactataacacaaagggcaagggacgatttaggccacaacatatatattttccttgttgctctcattacaccttttaaaccacttcaatgcaccctctaatatgaacctcacacctttttccccaaatataaaatgtctataagttgctccttttttaaaaatgacaacggtctgtaccttgctcttgttacagcaatttactcttttcattccttcaaaagcaaactaaaaccacaggctataattaccattgtcatgtaatttcctgcctcattcctcagttcactataatatccacctcaccattccgcaacatcacttcaactaatgctatcaaagataccccgattaccatattggattgatgctctttacttcttttcttgtatgacctcttggatccactttcaaccagtccatataatctcaatactcttctttatcacacaaatatattacacattatcatttccctctaattacaaatttctgtcctatattatagttcccctcttattacaaattcattgtggaatcccattctgatcatcctttaaatgttggcatgtatagggatttattctttcttctcttattattacacttttcctagatgatttatcctaatatcatgggttgaaatgccacctatcttctaatacacaatttgagcccctgggacccagctctatatgtttttccatttcccatatatgtacatttgatttttaatcaacttagcatccattatcctaaaactgctttgcaagtgtaaattcttcctcattgaatgatactcccatctacctactcagcaaaaataaaactacagaaattatccttcatttctcttttcccacaccactcatatacaatctccaaatcctataaattgtctcattaacatttcaaatatccgccctaagagtcatgccactgatattgccttagttctatttctcattatgcacaaagtttttatctgtatacactaagtccatctcaaatacgataatcttttaaaaacataaatctcatcatgtttcccttctgtataaaatatttcagtgacttgacatttgcccatatgctaagtttgaatttattatcattgcttaaagaataagttaaatgttagaatgtaagctctatgagagcaaattccttgtctttttatttaccattttattctcagtttagatctaactggatctcacagcaggtgaggctgaacagatgaaaagccttcaaacaagtccactgttatttcatttgtctacttcacttgtttatctcacctcttgacaagctcccaattataccctattttccagctattttgaagtttcctgaatatgccactttggataatacttaggggttttgcctactttgcttggacaactttaaacactggttctgactgcaaatgtttagttaccttttaaggttcactttaaacaacacatcctgtaaggtctctgtgaagccattactcaagtatagtctgcattcctctagctagtaatggtgctattatctttattacactgttagacgtgtgtctgtacaacctataagagcagtacattttttatacatttaaatctctgtctgttttgacaacaaaagcacattaggatattgtgataaacatatgcttgctttaaataaaaaggacataataaaaaatgctagagtctcagtagtctaagattttatgagatattttttcagacatacacatgtatacaaaagatgtatatgtgaactgcattgtaaagtaaaatgtatttcatacaatgggcaaggtcaaaaagattttttaaagtcacactagattaacatttctttaaaaacagaaactgggtctatatactttttatctctatcatagagcactttgctagatgcatactagtttctgaaaggtatttattattaaaataattatccctttaaaagcatgacttccagaacctctgagtagtatcatagtatgagactcgggtgagttctcctttatggtaacagaaaaaatggtccctaaagacggtcacatcctaattcttggaacctatgaatatgtttgtttacatggtaaaagggacttttcagttgtgattaaataggaatcttgagatggaaagattttcctggtttattagataagacgaatatatagtaattagaaagctccttataagaagaagaaagagggtcaacgtcagagagaagctgtgttgccagaagcagagattgaagtgattggctggaaggtagaggaaggggcctgagctaaggaaagcaggtggcccccataagccaggaaaggcaagaaaaatggattctcctctaggacctccagaggagaaggggagaaatcttacattactatttactcatatcacctagcactttctattgaacataagaaacacccattaatgtttcataatcaattctattcatgtgatttttgcctcaaaacacatttatattttcctggacagtgagtatttatgaacctagatatgaccaaacctcagagttttgaattttgaaatctgatctttattttaaaagcatttgtattactatgtgcaatattaatagttatcatagttttaattcagacatatatggtgtttgctcttttttagtatttagattctgatttagcctataggcatcttgtctttgtaatgccaagagtatttcagctctgatctatgtgcagaatactatattaaataaaaagaaacacattcatgagataagcaccattcatgaagaagaatggcaatgaaatgaatacccataaatggcaagagccgtacatgtgggaaaatactggtataaacttagaatattgattggcatttctccaaccacatgttatacaggctgatattatctgagaaagataaaattgtatctaagaaagataaagttgtatgctttttctttattacaaactttattaacatatgctttgatgaacttcaaatatcttataattaaacattttttattatctggttgttttcatttgtggattttgttccctcagtgtcccatatcccataattttatccaaggtatccacaatctatctcattagccagaccgttactgggctcttgtcccaggacttaaaagtaatattgagaatgggactggaccccttaactttgagaaaagaaggtttttattcttgtctgcaatctcttcccattagctaatacattcttttcaaggaacagatctggaaacttgccattttgaatgttacacttgggattacagtaatttacagtttttactaatgttttgcttactggtataggtctatatctataatatgtttatgtgattcttgaaagcctaaatgaagtccatttggtaggatttaagaatggaattttgactatctgatttgtctttccagtaataaagatttgaatccttgctctaaaatggatataaagctgaaataatataaggtaacatttgctgaaataaaagcttggttgacctttttgacttcattttaaaactgtgtgagccctctaattgctctgttagcatttctggcgggggttatatcaatgcattatctcaatattatttgttgtactatgctgtctatatttaccacaatgttatttttgacattaatgtaccacacaaaaaataagtaggaaagaacaggtcatttttgcaaatgcacagtaatttgttagcttctatgaattatgtatcagtctggctgtggtttttattagaatttgtagattcagggaacaaatgcctcattaaattttaaaaaatgcttttctgtacttattctctacaataagtttttttaacatataaggcagtgacaataatgtaagattatagactatttttaaaaaacatatttatttaaatcatagcctggtttcatgtaagtgctgaactctgatttaggggccctgggtcttagtttaggcctgttactaatcgtgtatcattcatagaatgtgtaggtaattctcttcttggccttaagtttgcttatgtgaaaaggaaaatggtagctaatttataagtgatgtagtgtgcctcagtccaaaacaaagataggttttgaagacaaatttgtgtttatacctttttctggcatgtgttacttgcacaaacttgagtgagtttttactttttgagtatccatttcctcatctgtaaatttgactaaggtatgtctatcattataagaaataaatcaaaatgagacaatatctaattatatcctgtatctgatggatttccattattcactattaaaatttctcttataattctttctggctgatacacatgtaatactgataacagcaaacacaaagagaaattactatgtgccaagtttaaggttatgtagtttacatactttacatcatttagtcctcataacaacctaatgaagtagtaactatgtgttttttattttatttgtaaaaatttatgggtacaagtgtaatttcgttacatggatagattgcagattgggaagtctgagcttttagtgtatcctaaacatcctgaacattgtacccattaagtaatttctcatcattcactcccttcacatccactgtccccactctgtctattattctacattctatatccatgtatacacattttttagctctgacttataagtgaaacatgcagtatttgtctttctgtatctgacttgttttacttaagaaaatgatctatagttccattcgtggtgctgattttattcctttatatggctaaatagtattccactgtgcatatataccatattttctttatccagtcatccactgatgagcatttaattgattccatatgtttgctattgtgaatagtgctgcaataaatatatgggtgcaggtatcttttgatataattattaattttgctgttagtagatatccagtagtggaattgttggatcaaatggcagttctagttttagttctttaagaaatctccatattgctttccacagagattttactaatttacaatcccactaacagtgtatcagtgttccctttactgtgcatcttcgccaacatctgtttttttttctttttactaatagccattctgactgatgtaagatgatctctcattgtgattttaatttgcatttcactgatgattagtgatgttgagcattttttcatatgcctgttggcttgcagtagtaactaacatttaaacttaagttaattacccaaatttattcaactggcaagtagcagagctgggagttgcacattcaaaatctggatctagagtccatgctcttagttgttacgctgtgctgacaaccatacacagtccatttaccacatattaacataaactttgtttctaattcttaattctacactttatattagaaatagggtgtaaataacagtcgggaaacctgacttttggatttagcctgtcaatcacaagctacaacatgtaaccgctctggctgactctcaccatttggaaatcatcgttatatttgccctctcagcctcaagattctatttaaagaaaatgagagagagaaaattaaaataatttttgtggttgttttataacacgaaaatgattgttacaaaatgattgttataaaacaatatcaaaatgaagaatttgcaccttcagttatgaagtcagttacacaactcgacaataaatcagtaaataaataagtaacccttgtttccttcttaattatgataaccctattagtaacactcatacaaacaagttggttacacaatggtgagggaaatgaacatttatttagcagctagattttatggaactttgagtcatattcataacatattaccaggtctatattctccctcgagaaactaacttgctaagtggctaagtttcatccattaggaagggatagactcaggatttgcactccaatctcttctattttttttttttcttctagagacagggtcttcccctgtcacccaagctggaatgcagtggtgccatgatagctcactgcaacctagaactcctggactcaagcatcttccctccttagccccttgagtagctggtagtacaggtgtgcaccaccgtattcagctactttttttcttttgtataggggaagtctcactatatttcccaggctggtcttgaactcctggcctcaagtaatctcctacattaacttccccacatgctggaattacaagcgtgagccactgtgcccagacccccatatcttctctttatataaacaaactctgcagcctctttcaggtagcatcaggagaagactatgatattaaacttaacttgaagaaaacttttcaagagcaaactggagttacattttgcctatcgaagttagatgaacttttattcttaaaatatattttagagaagttgaatgtttctcatcttatatcaggatcaaaaataaaacaaaattcaaagaagaaaagaccatttcaaatattttataacttgtcaatatgcttccaatccagaaattttatggaattggtttctgagttttgcccaacatttatcatctttgtttgacatataccgttaaaactaaaggaaggtataaggggtatttccagcaataaggagaaataaaaagagcagagtaaaaatagaagggaaataagtgagatgacaaatataaagcataatgcataaaaggagaatttttaagtgatcaaaagaggtgaagcttgggcaaaacaaaattaattatctttttttaggagcttaaaattcttttaaattttaaaattgactgtggaagttgcaaggataaaggcaagttgtaaggataggaacatggtctatataagattcatttgccttttctcccttattattaggaagttttgatggctttataaattatctcatttaactagtggatttcttgctcaaggattatatttcaaagaatacattaggatgatgactgcgtgccagaaataaaaatctgatattacagaaaaatagtgatgctttaaaatgtatggaatgcagtctctatttcagtcttattattatttcttattttatttgtaatagaactttcaaatcagtgaaaaatgttaaacaacatcttggatccaatttgtggttcaagaggctgccgcaaaaaatgtcctcctggctttaaaaaatgatcatattcattagttttgacgtaaaaaaagttctgaaacacttctgaatcattagcaatgtatgatgtctggtatcaagcataatttataatgtaggaaataagatcaaggaaggaagtaaaaggaataaataatttggcaaaattgaaatccaaaagcagtggagaacatggcgcccagataagtaaagattgacttgttggacacacatctgcatctgttcaccccagaaatatggtgtcctaggtctttgacacctagactaattgaagagtttactcagctatggactatattgttcaggagtaccttgaatactagtaggtttaaccacgtgacatcactgatatttgacacattttgaccagcaaaatagtcaattctatactgtacagactggatagaatgaaacctgcttataaaaagtattttttattctagcttgaatgaagtgggaaagcagagtcagaaacaatctacacccactcaaaatggaaagatgttgatttagtatattacaagaagacatcatatactcaaaaaaaatgaattactctctttctctatcatacaaaagaaaacaattcaatttttggattcttcataaaacaataaaccaacaaccatgacacttaaaacactcttgctgaggtttcactgagtctatgccaactgcagcatgtttttgaaaagaaatgattagttatcatggtctatataaatcagttctgttctcctttaaaaaaatgtgcacattctgacttaattttagatagctgccctgtaggaacggaaaaaaaaaaatgtaattgtttggtggtagcagtaagtgatcagaagtaaccatctgcaaaaacacactttagcttaaggaaatgtgccttggggagataccacagcatatccaatcccattgtagaactcagcaagaagagtttgctttctttcagagtctcgtcctacttaaaaagtgtaattgaagagaccagctgctaagttgcaaggcctgatagaatagtagttacactactcaaccgaaatgtttgctaatactaggaatgacttctagttttaatcctccaaaaggatgctaaaacatggtttacgggaaacatgagaaatgtaatacaaggcaaaacatgctactttgattatctcagacataataaatgggctaatttgtactttaaaagcttcctgtagcgcactctgtattgactactttgaatttcagccatctttccatatcagctttggaagctctcagggctatagccatttgttcagatcaggtctgtcttcagtagataagtctctcaggtaatttggagcaaaaggggaaaatgtaatgctttttatggtctaaaagtaggaaatatctcctgcccaattaattaatgctattcttttttatgtattatttaagatttgttttattttctcatataggtggactccaatggcagcatcaagatgttctcccagttgtactcggaaagatatgcttctgaggggaaagctatttttttcctaaatgcatattaggtaaaaagtgtgtgtcagagataaaagtatgctgattaagaccctagtcttggggcaattagacttgcatcacagtctcccaactctatttgctaattgtttaataaattctctataccgtaatttattatcttgatggattaacaacagtaacaccatcttagaatttttaagaagaataaatgggattatacatataaaatgatgagcacactatcaggaccacagatgtttgtgttgttgcttttctttaggtttatccacactgtcctcctacctccataaggacacagtaaagtcttctggattagaagtgaagaaaaattaaatagaacttttatttattgaaaatttatctcaagtgtcctgtttcaaactgaaatgacagtgtttatttaaatcacaagaaactcaattttagttggtaaacttaagtttttcccactaaccgccaatgtagaagggaaaaaaataggtgcattatagagtattaacgagtcttattttattagcacatccaagtttgtcactgttaaatttatgtcacctcctttcacttaaatgggatattgtcatttattcagaaaataggtacagacttttctgcatatttactggaaaattctatgtgcaatgaaaattagactcaaatgtgatctctgagtttatgttctagttagagaataagacatacacacattcatccatccaaattaaagtacatatggaaagaaagatataactttaatacaaaagaggcaccaacattgaaaaccgatatcatacaaatgatccacagaactaaggtattcataaaaaagtagttaacactattgttttggctaaacctaaaaaacaaaagtttgtaaccaaaaattgatgcaagactggatacatagttacatagtatgaagtgccagtgcaaaataaaaatagagagttccttgttcaaaaatcatttaaaatttcaagatggcatttataatttcaagatggcaaccttcaagaagaaggttaaaccaagtacggacccttctgagcacagggctctaggcgactgcatgtttcagacacataaagtaggtccagcattgagcagaattaagataaggcctttttagctagagaagaaggcagcatgggatatttcaggtagggaatgatatcagtttgggtcctctgagaagcagacatggagacaaagttagatgtacaagagctttatagatgggagttaggggagtggaggataatgcctgtgaaagataaagtgggagaaatcagtactgagcagggaacccttcagattgtgaagaagatctgacatttgtggaaggaaagaagagagaaagaaaatttggggaaggagaggtctgaatgtaattcacatctgagaaagtctcagccaaaccaatggagagttccaaagtagatggctcattcaagggttcccaagttgcttgaaaatggccaaggcctagtagctcttccatgcttactcattggctgggggcttcctggggggaggcatgacattgactctaatgctgtgacaggtgctgaatgtgctgtgtagttgaaggctgccagctaacagctctccttgcagcacaacagcatgatctattatgaaaggaaatctgaccagtgcatgtctacaggcatcacagagtgcagaacttttctgagtggggaagaattaaagaaggaatttcaacttcaaactttgtttcaacttcagtaaaaatcccttatatttatccattactttatgattttcaaatcctttcacattcatatttctaacttcaccataaaagtatttgttgacaaaatgtttaaaagtaaatgcattagcttgaggttgctctttgactctattctacattttccagctgacagaatgacaatgctgggagatggtcatgttctattcagagtactgctttgccatttcctttatcaaattatgctatcctgaagattccttttacatgaattatacatatgtgcaaatttcagcaaatttcagcaggaaggtaatttagaaattgcccaatctacattctcaaaaaaaagttttcctctctctcaccttataatcaagactaatcttgtggttaaaaataattttaaaggttacctaatgcattcattcatgtaatcatttagtgtgcatcagatactgtgctagacactagagataaaatgataaaaagtaacacacagcccctcacttctagtacagtgatttttaaacttcagtttgtataataattattgcaaaatccattaaaaatacagattcctgggcctcaccttcagagatattatttagcaaatcaaagatctgactcgtgaatctgtgattatcagaaacatcccaaggacttttgtaaatatagctctcaggaaattgtttgaatactctttgttgttaattgaaggagaaagacatttaaaaagatagcaatttagttaatattatgtgtggtaggctgaaccgtggcccccaaagatgtccatgtcctagtcactggaagctgtatgtcattttacatgacaaaggggactttacagttgtgattaaattgatcatctcaaaatgggaagattgttctggcttatctggatgggctcaatgcaaccacaagggttctgataagttggagacaattgtgttagcatcagacaggaagatacaattacagaagcagaggatctgagttgaagagggatttgaagaaactgttgttggctttgaaggtggagaaaggagtcaggagcccaaaatgcagttggcctctaaacactggaaaagctaaggagacagattcttaccccactatattcccctaaggcgtaggccttgataagaccttgattttggcacaaatgaagcccaattaggacttctttttttctttcctttttttttttttttttttaacatttatattgtttttcctcaggttgaaccatttagcacttctgacattgagaaatataagataataaatttgtgttgttttaagccactaagattttgtaatttgttacagcagcaataggaaatcaatgcatcatataatagaaatacataaagcagaatgtggctatggagaagggaatacttgactgatttcaaagaactcagaaagactgtattttgcatgtgtggaatgaacaaacttcagaaatttcaaagtaaaaaaattgaaaacattaaatcttggaggcattggcatcattagggggacaaaatagtgtaaatgcaattccagttgaggaaatgtttataaaggatggaggaggagagaatttcctttttgccctctgaagttttgcaaaaaaaaaaaaaagaaaaaaaaaggcagattaattggttctataaaagacatatagatttatttttgatcacagttttatgtaatacaggagccttcagaatgaagacccaatctcccagtcgggtgtagaagcttatagagcatcttgatgttacaggaagaatggaggctcagagcatggccaaaaacagggttatgtcagtaaattaggatttagtgacaacataggttacaggagggagaggagaggaaatttgactagcaaaggtggtcttgttatggtaaatgaaacctcagagggagtagatggcaaatgtctcctttagatctttaaaggtgtcagattcctagttgttctttcctagatccagacaaggaaaggcctcactactttaatgtagattctttacaaatacaaattatccccaaaagacagctttcaaggaccatttcttgtgctggccctctgacagccaactcaaaatatgtcaaataaatatattttagggtaaaatgttttgattttttttcactgggcactttggaggtatcgtaggttgattgcagaggcatagaatgcatgcaaataggcaggaaaagtagacaggggccaacttaagagagatttgaataatgtgttaaatattttgcttttaatttatctggaagagaacacaatagaaagatttcaaatattaggacaacagggtcatagttgtgctataattatggaccctggaagccatctggacaatggctgaaatagattaaataatgtcggagctttccaggtgaaaaatgtataggattaagacactcttggtgaagattcagagaagcaggtttaatttgcactttcagacactaaaaactaaaaagatcatgagatgtctttcccgacatgtgagaaacaaagtgacccattctcaactataaggtacaaaacatttttacgatgaattttaaatttcttccttggtgttctgattgcaaagttctagatacattgatcaatcccgaactttattcagtgtgtgtgagtgtgtgtgtgtgtgtgtgtgtaagagacagcatgcttatatatgcacacacatttatttttatctgttgctttaacatatttagtctatttgttggattagagaaaataaaagtgtaaccaaatcatgagccagtggcttgcagtatgcaggattcaattgctacagtagttagctagtcagacaggaacggggcagaagagaacccttacccacaaccaggaatgtcagctgaccatcaggtgatggttaggcacttgttaactatctctctaaaagaataattgggcacagctggcaccagggaagggccgtctcccaatagataagaaaaacctgaagctggtggtcattagcttcctattaagatctcaggagctgggtgagtgggctcacacatatgcactgagaggcaaaattatggtgtttcactggtatatgacctcctaagatgttgggctgctaatggaagaatgcctcaagtgagcatgcgtacaactcctgtaaacacactgcacatgctcccctccaaagtactagcaggccactgtgcatgcggacagcacaccccaagggaagaatcaggggaaaaggaatacaagaccctggtagtatgccaacgtacaaaaccccaagtcaaatggtcaaaccacacatttaatctctcaagtctcctgcttggccctcttccaaagtgtactttactctctttttcatttctgctctgaagctttttaataaactttcattcctgctctaaaacttgcctcagtctcttcttctgccttatgccccgcagtcacattccttctgagggggcaagaattgaggttgctgcagacctgtacggatttgcccccaatcacacaatgaacatgagtgaggtctggtatacagaaagtaatttatttccaaagctagctaaggtgaagacacacaagtgtctcacctttaaatataccacttcacctttagagccgaaagtgggcatttttgaaagacaggagagcaagtgaccaaggggtcagggggtcacttgttagctctggtgtctaatctactgaacatagagctggtgactgctggtgcctttgatggcaggactaagctgaaaactccccacatgtgaaggagtttcatagaaactggcttttatttccggcaacaactctcggtgggtgaaagtcccaaggcaaccccctggagggtgagagttccatgttttagtctgcaaactgactgttaactctcaaagagagatctgtcttggagcacgtagatgaaattgccccataggcagtgtttggtgaaggggaagcaaaaggttatctttacatttctaaagggctaagtaggaagtagggaatgagaaaataagagaaagagaaaaaaaaatgtcttagaaaaatgggagtattcagttataaaaggaaatattaggaagatagaatggacagaattggtaagatagatttcaaatgtgagaaagtaaaatacaggacacagatattttgattttcttttgtttttctatttttggagctcagaagacaatatcctaaaatgaaggcagcagcagcagcagcagcctgggaaacaaaagttcttctctgatcttcccctgccttccgttctccaacccctccctgactgccccccaatccctgacacagaaactaaaatccctcttccccaagcgagaacatagaaaccctttttcctaaaagccagccataaaacctaaaaatattctatgtaaaaactggccataacaggagctcaagggaagcctgggcaacatagccagaccccatctctacaaaataaaaattaaaaattagccaagctctgcatgcctgtagccctgctacttgggaggaaaaggtggcagaatctcttatgatcaagagtttgaggccacaaagagccatgattgtgcttctgcattccagcctgggcgagagagcaagaccctgtctctgaaacaaaaattaaagaaaactggtcataaagaaattatctgacctactttgtttgattataggtcgtttagacccctattccagagaggaacctgccctatactcagaaggaagaatggatgcctagagaggacaagaagaatctagacatactagatgtgctgggtttctccactcagtctattagcattagctcatactcttcttgtccaataatatttctacagagctgtattagtctgttctcacactgctaatagaaaacatgtacattaacatattatagattacctgtagccatgggatttacgatttcctttccagagagttataggactatcttacatagtctttttattgaaataatgtaagcttttgatttagttagaaaattctaattctatattgtttataaactagtaaaatagtaatcaaaacattctcaaaatcaattgttatgaaaagaaaagatacatatttgaagtttgttctttgtaaaattatttcttgaattttttatgtgaaaggtgctaattattataaattataaaaaagaattaaaaaacactatatatataaatatcaaatgcatgtaatatgcatatacatatatatacatgtgtttgctttattaaacaaatgtgatattatactatgacagatttacatatttgtatatctgttagaaaaacactgggaaaacatatggcaaatttaaataaaaattacctatagataacagaaattttagtacttcattttttaaaaaattctgaaattaacatgaattacttctgaaatcagaaaaatgacattagaaattatacaaaaatatgtaacatgtatttgcccttaaaagagtttgtgagccctttctatactgtcattgaagcagccaatcagataagttaggttttatactagatctactttgtgtttaagaggtgttttgactaaaaatccaatatgcagaaccatgatttgatgtttctatcaccatatgatggactatgtttaaacaatgcaaattatagattcaattcactgacagcactgattttttgacctgaaatacttatgccaagaaaacataagtaggaatcaaaataaaaatttttttaaaaaaagaaattggggtttgtggtaacagaatggtcttatttttcttgcatcagttatacaaccatctttatttgccattttgtagatacttgaaaattgtatttatcacagggcattttcacatttttaaaaaatattttctgttccttgtggcccatccatgtgttaaggctttgacaatccctggggaggatcctgaggcctttgtggctacatgaaccataacctacaccttttatcatatacaaaaataaatcaaatagatcatagacctaaatgtaaagtctaaggccataaaacatctaaaaagcttgccacaaagatttcttagctgtaatataaaaagcaagaaacataaaagagagaaaaatgataaattggacttcactgaaattaaaactagatttttgaaaggaaatattaagaaaatgaagagacaaaccacagaatggagaaatgtttgcaaagcacctgataaaggattgatggcaccagactacataaagaaccattatatctcaataagaagaagatacacaacacaatatagaaaagagtaactgatgtgaacagatccctcagataaatgcacacaaaacgtaaataactacaaaaaattgttcatcattacatcattagggaagtgaaaattaaaatcataacgagataccaatacatacctattgaatggctaaaataacaatattaataataataatacctgaaaatatcaagtgatgacaaggatgtggagcaactaaaactcatatacattatttgtagaaataaaaatatcatatagcccctttggaaaacagctagatagcttcctataaaggaaagtacatgtttaccatatgaatcaacaattcagtgcctaggtatttacccgaaagaaatgaaagcatctgcaataaattctccatgcaaatatgcatagtagctttatttataattgcacaaattgaaagcaacccaattatctctcaactaatgaatatataaacatatggtgtcatagtcataatatggcatataactcaaagtggcaataaaagactgaatgactgttaatgcaatgacattatggctatcaaatgcagtataataagtgtaacaaggcccagatcagaaagcaacatactctataattatatgacttcaaaggggccttttgagggtgatgagaatgttctacatcttgattgtagtggtggttatactattttgaatatttgtccaaattaataaaagtgaacacacaaaaagattaaattttactccatacgaattatacctcaataaacctaattttaaaatacagactcccagaaaatagatatatcactaactatacatgtggtgatgatataaatattcagttttgttctgtggctcagtcccacaatttattcttcaatgaaatttagggtttttctttaatgttttcatttttatgtttcttagaaatcagtccttactttttttcctgccactacaccctaatcgacttaataatagcaactttcttcaagggtcctttcttgaggaaattaacttcttggtgacttaatttcttggtgacctcatggatatgctgaattggaatgaagtctacagaccttctactggacatctttcaatttctctgtggtcattttttaatccaacttctccagctacaaaaagctgatcttccatcaaaatttctggaaagtactgctgaaaaatccgtgcttactttcactcattacagcttatattatttcatgtataaaagtagcttggaaaatccacattatgctaatgtgtaggctgtggatgaaatttaatattgtcagacacagtattttattctgtaagcaaaaaattgatttactcaaacattatttattccacatagaaaatctatatcatcatgaagcatatttcagacacttaacattgtggtccctcaaactcatgatttgatattatgtgtagcctgttaaaaaacactgtcattacattaaaatgaaactccaccgcttcctgtcacttaagtaaacaagagattccaatatattgcaatctaaactaaaaacatcagttctttctttgatataaaattatacctaaaatgtacataccacggtgagcattatctctgatatcattaaatcaaataagctttttactacaaaatcagttattatatatattgaatatatataatgtataaaatatagtaattattatttttctcatgttattctgcaattaaaaataaaaaataaatttcagctttctgctacaaaatgaagtgatagattcccatttctgcttttagtttgtgcatattttacactggctttaaatagaactttccatttctatttgatgtgacattaggaaagagcaacttgtggggttatagtatgtagaccatttctcaattttatcctaggaataatgtgaaatagttattgttatttcatttacattttttctgtgcctttttgaaattttagaccagttaaaaagtaaaatgggttcacttcctaagcatacagtgaaatgacatgcaatcaggtgatttcattcaatttaccttttaatttgcttttgaattttagttctattacttaaagggatatattaataagaaaaaaaatccagggcaaatcagtttgtctgtctttgagcttgggatagggtacacaccgttaggttgtatggccagaaagcattgtaggaaaagatgatattcaattatttactaccagctgtttctggttctgaaaatccatagtctatcctataaggtcctcttcaactagatgttttccttaactatttagaaaaagacaacacatagacagacataactttttaattgacttaaaaattgtgacttttaattggagtatttatcatagtccattaaattagatttaatgtaatcctccatattcttggaaataggtctatgcttaggccagataaaaggcttctaatgttacaaatatgtctaccttataaaccagcaccatcaaatattaacaaatatagacgaaattatatattcgaaactaaaggaagaagaaagaaggaaggaaggatacaggaggaaataaatgactgcctaaatgaggacatgcaatggctatttattcagagctatagcaaaggagtcagctaccatcacttgtatttggcaaagactcaaaggcaggcagaatggtgggaaagcttcacagtgcaaaaaataaaagagaaaggcttcaggtattttctgcttggaagctgttgacatagagaagctgtaagcaagctagttagaagtgggcattctgtgtgattggttaaggggaaaatgtttggctttctctggttggtcctatggaaggagagggagggaacctggattctcacctccacttgtcttccaatcttttctcagtgcctcgcattaactagacttacctggaaaccagagagcacagtgaggagcatgagaaatatttgtccctgcagtacaaagcagagcactggaagggtgaagggggaatttaagtacaaacaaaataaaggctacactctgtaaatatccgtcattagatatgctagattgtgaatttatattttagattttgaataaaatagtcaagtcctaaaccaatactcatatacagctgtggtctccattgacagtctgcatcacagcaaatgtatgtttgattctgtatttgaaagctacatttctgaaggtaggcaagaattgttgataaattgaaatactttaaagtattaggagtgattatggattatcatgtgtgctatagttattcatttttgctcttgcttccttatatttgctttgccaagtctcagaattctacttcctactctcttagttgtactttcactagtgatgtttttaagtcagtttctaccacaggcatcagtagatatcacaggaaatggtcagttgctttgattggttatcacgttgcttacaattactccacctccttttccttatgagacactgaactcccacatatctatctataatcctttgctcagaaaaattatactggccatgtttccaggttatttcttctagcattgaacttaaaaaaaattgcacaatatcgggcctgccagacagtagagggcaggaggagggagaggagcagaaaaagtacctattgagtactaagcttagtacctgggtgatgaaataatctgtacatcaaatgcccatgacaagagtttccctatatgacaaatttgcacatgtacccctgaacctaaaataaaagttaaaaaaaatcctgcaacaaagtgtacctcaaaagatacttttgaaactgtgggccaggtgcaatcccaacatttttggaggctgaggcgggagaatcacttgagcccaggagttcaagaccagacctggcaatatatcaagactgtctctatttaaaaaaataaaattttgaaataataattagattcctgagggaagcaaatattattctccttgctccttacttatacccaaccaacttcctgtaacatttttggacacagattaactcccagtgtcaaatgcaagtttggttacaaaatattcatttgctgagttgtgatataaatatgtacatactaacaccttatttacaattgaaagataattttcatgtacacatataaaattgtcatttatcttgtcttttctaaaggtgacatgtgtggtatatgtaaaggcacctaattccacttttaaagagcagtaactaattttttaataattttgaaaagtaagcaacattctcaatgaggtttgaacagtaaagtgttcaatgaaatcatctcttcagcctaggaagtcatggcttcagtctagacttttccttccttcctttttcattgtctgaatatcttgctgtcttcatagatgccatgatatctcccatcagcaatctggaaatacggtctactagatcatttgaagaataataaaaactaacatagaaagttattactatgtggtaattatatagattaccatttaatcctcacaataatcctaaagtagctataattatcatacttttaagacaagaaatctgagacaaagtgaagtaattagcccaagtttacacagctaataaatagcagagttagaattgaaaccaagaaagtctggctccaaatttgtgttcttaattcatacattctaccacccctaccagtcagcatttgtaatgtcagtttacatgaatcaaggtagaaagaaggacgtagacaaaatgttgaccatcatgaaacaacaacatgtccatgaagctacaagatggcttaacaatcaataagtgagtcactgtcagaggcagagaagcacttgccttcttctgctttcttagaaatttggtcaggggtatgtgtacataaatacacatattaagaaggaagctttcctcaagacagttcaaagagaaaccagaaaaccaacaatagcccttgccaagaaggtctagtataaccagccaaatcattcatgcgatctcccattggactacttcgctattctatttcctctgtcccactagaactgacggttcattttcatctcattacttccattccacctaggccaatttatttttgctctgaactcacagtaccagatacaaacgtataaatatagccttcataaacacataatcacaacatctaatcaccatgtagtactttaacacattcaagtcacttttaaaacattaatttaaaatatccatgaagcctattgtgaaagatggttttatcctctgctattaatgcctgaactggatagtgtgatgcttcctctaaaagcttggggactcctgaattactttggatgactaacattctgaaacacatagagataggatataacattgccttcagttatatttagccctcttttgtcattataatttagctcttatataaatgattagtcgaagcgtaattgctgtttatagccctacagctttttcatggtaacatatctaacacctgtcaagaagagtggctactgttttgagagcctccagctaagtgtggtcttcagtaccgtggtgctagcagccctgccctaatgagaaatgaaggggagctggacctggatgtttacagtgtgcctttcagaggacacttcttttacctggcttacctggcagacagcctaaagactcgttgtctgacctgtgaccagaagtccctcacaggggaaatttgttcattttggcagatgcctttgtggctcttttctgacctctgtccagtttatgccttcctgatcgtcactctggctctaggagcctgactttgtgttctccctggtatcagggggaaaacctgggacagcccctagttgttctaatggaaggtgcaaatttaatttaccaccacagcaagaaacaagttcaaagatgttttacttacagatcctgggccaggagagcagtcctccatccccaggtgatgtgaggcaagaatgaagagttaggtagagaaagacagagtaagcacctgcgcaactagcggaatgtaaaagggagtaataggatatggatccctttaagtttgcaggcaaatgcctgaatggtttaaaggaggtagcaggaaagtggggagtcctatctggtaggcagaagagatgccactaagttcttatctctgaccaccagcttaagtcatttggttgtggtatagaactggaaactgtctcaaaggtgactgagccttgctttcggtatgaggaagctgaacttgtattcaaaatggatgccaaggcaacagaaaattataactcactacattcgttttaaaagtatttggataactttaaactggttcaattcattctttatgagcattggacccagtctctgctccttcttgcaaattactgtcagctcaaaaacgtgatgcgatctgcagaagttaaagagctaaacgttgcattgtttatacactagaggcctgtttttctccaacgccatctgaaattatctatgcttttctttgcaaaacattgaatgacataagaggtttagataagaacatgacccaaaagccaaagatagccagagttttcaaatatatgtcaagatatttcagatcagagcaaacatgtatcaaaaacgagttcattttattctttttcttaactaagaatctgagaatgtttgccttattgcaaggtagggaagttttttttgtttgtttgtttttgtttgttttgccatgcagttttcacaaggttttgaaagtttttgtcagctgcgctttttaatttgaatggaaagctttacttacacactatatgtgtgtgtgtgtgtgtgtgtgtatatatatataaatttatatatattatatattttttttccctttgtgtttagctgcagtcattcaaatgtgtttgaccacctggctgtcaggttttataagtttatggtgagagagctaaatcccaattgtttttgtcactggtatgtcaaatgtagagttatgtggctagtgagatatagctcctctggtgagataagtgctgctgcagacatctcacatgctgtagagccaaggttaagaaaaagaaaaagatacaaatcagctttattatcaaacacagctctgacgatccaaaggggacagaggacaccatataaacatgatgcagccctgttgtgccatcctttctgtatgaagtgaggtgcctaattaagacagtaggcatcagtccagctgcaaagaggtagttaagcagagaaaatgcacgtggttgccatccaagtgcttgcccttactctaagtgttcaaagacaaagtgctgaggctcaatcttttcagattcccacaagttcttccttcatcctcctttatgagcccaggcccacacagggctgctggtaaccaaagactctagctgctccttagagggtgagccactgctgccctgggtcctcaatgtctttataattaggttgatgcccaaaatgtttgaggacaatgtctctccaaatgccttactttccaggatgcttggagaattctactccttcctttttttttttttttttttttaaattacatttcttactatttcctgtcaatgggaacaacctcaggtttcctcctaataaataaaagcctgccagtgccagcaattactacagcaggtgacatgaagagcaaagggaagggctggtttgatgaggagctgagctcttgaacatgcaaagaaaagtaattctggcaccttggcaagagaatctgaagtttttgaaaacaaaaatagtgacaatggttcctctccagtccagctaggtcctgcttattaaagcagaggcatgaaggtacacagatatatgcatacttacaaacacatacagagacatgcaaaatcactaccatcaccaccaccaaacagcacctgagccttcattctgaataatcagaacagatttataaaatgaagaccaataaattgctcaccctctatacctcctgatatggtctgtgtccctacccaaatctcatcttgagttgtagttcccataatggccccctgtagtgggaaggacctggtgggaggtaattgaatcatgggactggttacctccatgctgttttcatgatagtgagtgagttctcacgagatctgatggttttattagaggcttttcccctttgcttggcacttctctctcctgccaccctgtgaagaaggaggtatttgcttccccttctgccatgattgtaagtttcctgaggcctccccagccctgcagaactgtgagtcaattaaacctcttcctttataaattacctagtctcagacagttcttcatgagagtattagaacagactaatacacctctgaatccaatttagatgtatagttcaaacactacaacgcaatcctctatgtttaattatcttttaatcttgccttgcagaagaatttccaagcatttttttaaactgtggtgagataatttaaggatgaaaattaatttggtttttgcttggagttttgactggcttacagaattcacagattacctaacatttataaaatatgccttttgagagaaaacactagaattggaatggccttgaaggtgaattaagtaccaaaaggctgcttttgtgtaagtgagtgtcctttcactgccattcaccagagtctctgctcttccaaactcctagtttgcgattttcattggttttttaatattacaactcaggccattagatatagcctcagtgttcactataactgctgagtacatgctatttatccctgacattgccgtaagtcttcattgagcagcactcttttcagaaaccaagcacttaaatcttccaagctgtttcaatacttggcatcattactaaaaatgtcaatgatgatgacagccggtgtttgttgtagttagagccataacaaacacatttcaattggctattaaaaatatacatatatcattgatttttctaaagccctggatgatgtccagctgagattttctgcatgtggatattcattttgttactttttgaagtccatatttctttctcaccatgccattttaaatggtaatgtcagccatagcagcagaaacaagaacaacagcaataatacctaccatttactgtatatctactatgtaccagacactagatacttttgcttacttcaattgcccattacaacaatatcataatcaatattagtattattttaataacctctgtcacttataaggtggaattttgtatatttattgtgacccttcatatgaattaattaataacttattattttgtgttaaaattattttcctggcatccttcttcctcctttcacccttctttttttcggaatgagaaagttttctataatctcttgtatatatctgctcatttgaaggctaccaatttatttctacttagtgttttccttaattttaaagataggtatttaattttgagaacagtctataattatcagtatttctaacatcctcctgaccattttacagaatatttcagattttatgcattaattactgccttggcttctacagtcttaccataattatttcattttagtttcattctaatatttaatatgcaacctatattacttgttttgtagtgagtattttattaatttttctggtcaccattataacttgtttcctgtaccttcccctttgtctttttttttttctaaaatgcatctttttttttgagtttcaataggcagtaagatttatcaggctttgtatgtctgaaaatggctctatttggcctccacttttcaaggtttatttgcctgtacataaacttgtggtagttattttcacttggtgttttgagactatttctcattgtctctttgcctcaatagtgagtggtgaagaagtatactatcagcccatgttcttcttttaatccatctttttgcactagtaacttttgaaacattttctctaattgtgaagctagtcaactgcactgaaataaatctatgtacagtgtgcatttatttttattttcctgttccgtacttggagtatacgctttttttttttttttttttttttttgagacacagtctcgttctgtcacccaggctggagtgcagcggtgcaatcttggctcactgcaacctccgcctcctgggttcaagtgaatctcctgcctcagcctcccaagtagctgggattacaggcgcccgccactacgcccagctacttttttgtatttgtagtagagatggggtttcaccgtgttagccaggatggtcacgatctcccgacctcgtgatctgcccgccttggcctcccaaagtgctgggataacaggcatgagccaccgcacccagcctggagtgcacttttaatctgaagactcatgtgtttctcagattgtagaaagtttgcaatcatcttttgattcaaatattggtttactaccattcacactagtcttatctattaatacctgttagatcagacgtcaacaaacattttctcaaagaacgagagagtgaatactttagactttgaaggtcatatggtctctgttaacaactactcaactctgcgattgtaccataaaaacagtgataagcaatatatacattgaatgggcatagttgtgtttaaataaaaacttatttataaaaacaggtggcaagctggatattggtctcggcaagtagtttggcaaacctctgtgttagatgagtgcttaatcactttttcgatactccatgtctctcaagtactctttcaacttatcttaatctttttgcttttccagtgcattcttagtgaacccctctgtatcctcttcctatttgttaattttctgttcatctctactctgtcaaatacttattttgtctactgttatcttttaacatctgtaattttactttatttcaaagttttctcataaatttttttgcatattcacttgatcttattttatttctatatctttattttatagtttctgttccttcttagatatttgtcttttgaccatctgcaaatactgctggagttattgattttgttggctgtcttttcagaattagttttcctaacatggcttgaattttcatttgcaggccaatttgcttttgtttttctccctgtgaacataatattgtaacagtttttttttttgttttgttttgtttttttttaccaatctcctcctagctcagggttactgaatctgaggagatattggggttatggcagatctagtcgcagaaacagaatgtaatttagattcattcctaatattcccagagtgcaaaggcaggaagcatgtctctgatgtccatccctcacacagtaattttaattcttcttacccatcaatgactgaacctttggttgttactgcttactgccagagcccagctaataactctatccctcactcttttatacttgtttcgttttttcactgctcataatttttactttatacttcagctcagctgttgttgcttcattttatttaattttttataggttatagcaaataagttttgtagagccctaactcactgttcaatgctgatcccaaattgggtattactgttaatataaaaagataaaactaaggttgagaaatatctgtacaatttgctctttgcctcaagttattaagtgcctgagaagtgatacaaactacttagcttttgcttttccaacttgctacaatagttacagagataatcaaatcctctgtctacttctttattccttagcaattcattcacttttcattggcaagctcattccaaagaaatacttagccaatttaaaaagggatgcaacatacttctttattacagaataactaaaggatatttaccctgggattctttctaaggcattacagcaattctaaggcatgacatcctcagtgcagcaatggctggtgatgtgaagcataaggcaaaagaccttgagttccacggatttcaggacaggaaacaaagtgggactggctgctctgcttgcggaccaataatctgtgggtgttactaaagtacctttataaaatattttagacataatttcatgaatatctatcaagatttatctgtccctattttatttattgattcatttttgccctgtcacccaggctggagtgcagtggcacgagctcagctcactgcaacctccgcctcccaggttcaagcaattctcctgcctcagcctcccgagtagctaggattacaggtgcccaccaccatgcctggttaagttttatttgttttttttttttttttttgcttgtttgtttttgttttttgtatttttagtagagacagggtttcactacgttggccaggctggtctcaaactcctgacctcaggtggtctgcccaccttggcctctcaaagtgctgtgattacaggcatgagccaccgtgcccagccatctgctcctattttaaaagcaaacataacttgaggagttagagattcctcacaattttctacaaaacattttaattacatgaagtgaagctttggaactgtaagggactttaacaatattctatgaagtctagccatcttgtcttataggtcaataaactggagtccagggagttcaagaaatttacttatagtcacgttgttagtggctgaccttgaaattgattctaggatccagctgctgttacatattttgagtaaacctgagttaataagaggatataacgcaatgagtaatcttgagtgtatttagccatttaattattttgagcaaggtaggggattggaggttataaatgaagtgtatttaggcaaagaagggataaatgtatctttatctgatcttttgcctagactctatcatcacaaaatgtagcaccattagaatggataaattttatttagcctgtatattttttaaaaagactattttatagggagaattactcttccaaacctcagaatcttgactttaattcgggtcaggctgaaccatttgtctattttgaacaattcctcaagggtcatttaaattaattaacattttatgtgaaaaaaatcaggaataactgagaatgactaatccttcactataaaatgacctatgtggtttattaaaccgtgaactgaaacataaatgtgtaccaaaaacataactaaagtgtggttccagttttcattgcagttatatctaaagaactcttaaaagtttcagccatatgaagttaatagaattcactctgttctggttctatcgtgggtaagcaattctgctatactattttgccttatgtttgttaacctcagtgtccaatgatgcagtacatccattgcattctcagcagcattggttcatggaatggtataatatgcattcatccatttatatattctacaagttgttgaacaccaaacacatgccaagcaatttatttactttttaatgtttttattctatatagtgtgtgtgtgtgtgtgtgtgtgtgtgtgtgtatctatctatccatctatctatatggagagagacagagagaaagggagagagggagtctctttaagttgctcaggctgatcggctgatcttgagctcctggcctcagatgacccttctgcttcagccttccaaagtcccgggattagaattgtgagcctccacacccacccccagcattttttttcagtcattgagaatatgtcagaagataaaataaattccctgccttcgtaagacttatgttctagagaaaaaatacagaatataagtgaataactaaagaaaatgcatagttaatcagatggccataagtgtaatggctaaagataagcagagaaaggagataggaagtggttctgtgggtgtgtggatgtgggaaagatgactgaagttttaaatatggttgtcagggaaggcctcactgggaaggtaacatgtggggggattgaaaagagaagaagaaagtcatggagaaaagcactgtaggcaaagagaataaccagtgcagattcctggaggtgagggtgtgcttgaaatatttgagaaatagcaagacacctacttaacttttagactgttttaaactttcatttatgatttcaacaaacgttaattgaatattcaatgtggcccaaacacagtgctaagatctgggagcaccaatatgagtaagtaactattatacttatttgatgcttatgtgcatctagtaagggctctactcctaaaatgaaaaataaataaataaataaatatctagacacaataatgacacagagtagttttagttatttctcctggcactggtttgaggaaggataataatagtctgtgagaaacatttagagtagtaactaaaatatactttgacttgaagccacactctctctcccccaacacccaaacagaatcactggaaggtttcatttcaacttcctaccagagctctgaatggcttaaatgctttttatggcattttctaaagctgcctttcattcggggacatactgccccatgttcaccatctggaagttttttttacagaagctatttctttaatcactacctccactgctttcatgctatcccaagccactgattttatagctggggagaccaatgtttaaagtgttattcaattcttctctccagagaaacttagtaaaatttttcttgaactacattaaagttgataatagtcctaccttctacaatatatcagtgacagtgatgtaaatgggttaatgtcagtaatacatttgtagggattagcattgccacagtcaacaagagccctgtttttctgttagaaaaagaaactcattttagagactagtgctaagaacctaaagtgattattttaaagttatcttgtcaaacgtatggaatcaagtaatttatattatatatctatagtaaatgttgatgtagttactaaagatcatgtttgcgaaagtatttagtcatgagtaaatatttcttttaattctgaagcaaaaatatgaagaatctaatttgaatattcactatcatcccaaccaaataaataatattaataaaaagacagaacaaaaccagtaaattgttgataattgttattggtaggtagtaatatttagttttttaaatattcttcagttttccaagtgctgtatatgatattttaaatttttatctttttaaaaatttatttatttattcgatattcaggaggctgacgcaggaggattgcttgagcctaggatgccgaggttgcagtgagccgtgatcatgccactgcacttcagcctcggaaacagggagagagagagtccgtctcaaaaaaataaaaataaaaaaagcaataggatattattttttcccctaaaaacagaagctgttaggtctgtatttctagaaaataacagtgaactagatattcttcatgacacactttttcaccgggtaattttgtaggagcaatattaatctgaaattagataggatggtgacttatagatcagttttcagcactcattgctgaaatttgctgtcacttgaaatagttgattttgaaaaacaagcccaaaagatttgttttttcttcccagatagtttgcctatattggtaaatgtttccatcaaatgaagagtggaatattagtagtgtttacatcaaatgaagagtggatctaaagtttaaacatgaagatttcatccggctatgaatgaaagatgagagagtaacgtattttccttcctttttcgttttcatgcacaattcattattataaaaataattatgcactaatactcaattctgcatttattttacaagcatagtcaagatccactaaggctgtccttctcagatgtgactgtcagaccagcagcatcagcatcaccaaagtatgacctactctgtctgaaattctagagacagagctcaactccaggtgaattactttatgctaaagtgtgagaattgcagaataaggaaaacagcttaaataatacaaacaactaaactaatatagatactcttaccctctaagcacaactgttattaaaaacctcttagtaaagtcaactgttctttctactctcagaaaaatgattatagtttttcccttcagcagattgagccattgaaaaaaaattccaggctctaggtttgtgataaaccttccccacttaaatcttaagtgtgataaaagcctttaccaatgattaaactgagtgaaatgttaggctgtccttagactgatagagtcatatttatctggcaaacaaaggattaaaggacatctctcctggagatgtactatggtactatgggactatgggaagaagtaagaagcctagtatgactactaaatttttagcctgaaagactagttgtatttctaccaataatgtaaatagagtactcaggctaagacttgaattcgagtaaattaaacatcttctgtttcagcctcagtattctcattacaagtaactagccttacttctcagagttgcctatccaatatctaagatgttctgaagtgcctttctctatatcctgtatttctttatttttcatcatcggttccagaaacaaaaaaagattttgaacagaccatgcagtctttcctaagttacctaagcaatggaatcgttcactcaattaactcttccttcccttttttataggtgtttaatctatattgaattacttgtttccaagctcagcagttacgggggcaattgctacctgattttctattattttataaaaggacagtaatgttacaggacaggggtcccaatccagaccccaagagagggttcttggatctcacacaagaaagaattcagggtgagtccacagtgcaaagtgaaagcaagtttattaagaaagtaaaggagtaagagaatggctaccccatggacagagcagccctgagggctgctggttgcccatttttatggttatttcttgatgatatgccaaacaaggggtggattatcatgtctcccctttttagatcatatagggtaactctctgatgttgtcatgggatttgtaaactgtcatggcgctgatgggagcgtagtagtgaggaagaccagaggtcactcgtggctatcttggttttggtgggttttagccagcttctttactgcaatctgttttatcagtgaggtctttatgacctgtatcttgtgcagacctccaatctcatcctgtgacttagaatgccttaactgtttgggaatgcagcccagtaagtttcagcctcattttacccagctcctattcaagatggattcacatgcctctgacagtaatttgaaattattaattttaatggacattgtatgaaaaccttcctatatatataatctctatatattttaagtaaaactagactagccttgaaactactttggtcaatccatttatcatttgtgcccttcagtaaaataaaaataaattcatattttgttgtttttttttagaattctagaaatattccccaaattggaaaatatgtggactgagatttgtaatcagttttcaacattatcaaagagaaaaacattgcaccagacaaaataagcagagagaagttgatttcatttctatactattgtcagcaataggatgcctgaatacccagtcacccaccacccacccttacgccaaagagctggagagtttttaaaagttgggataggggccatctgagtttgctaattggccttactcaaaggaaaaatcacttttcttgtatcttcatgactggaggcaattttacagcttggaacaaaggcaacgttaggcccccactctcccacagaaactgaagtggggggatgaggaggggtggtttatctttcttgacaattacacttcgatagaatggctctcagatccttcaaaaagccattcttcagttctataacgagttagaagctttcaaaaaatttacgtctcaaagggccagagaaaggatgtacaattatgtgttttctagagtaaatgttctaagaaaaggaaggtcagggtcctaggtgagataaaagcttgtctaaaatttcgtgaaatcgagtggaaccttagattgtcttcatcaacttttaactttttgtgggattatatatataagcataaaaacatagcctttcatggttttctatcttagctcactggttaagaaaggggtcttcaaaaccttttcgtaaaggagatttttgtcctatttgagaatattttaactaacaaatgatgtaaataaaatattttctctataggaacaatgttcaacttttaatcaaatttagttaaaaaaaattatttttgagacaagcttgaaactgccattgcaaaattataaatgagaaaattattacagtgaaaaagatctgacctaaccaactccatcttgcttgtaatccccaagctgttcttgttcactcctgggtgtaggccaaattaactttgggaggaatttagtttatagtttgaaacaaagacaataacagcctttgcaggactaacaaattatccacaagattaaaaattgtggtttaggagtcatgcagctggaggctgcctgcgagattctaaacctcttcaaattactcctggtgataacatcactattgtaaaacctaagatcactgtctgagatattttgcagacctggcacttgatggatcagttggcaccacccagatcgataaagtggctcctctggtcttgttgccctcactcaggaaatgacagcacaagaggtcagcctcaactccctatgatttcatctccgacccaaccaatcagcactcccgactcactggcccctacccaccaaattgtccttaaaaaccctgatccccaagttttcagggagactgatttgagtaacaatagaatcctggtcacctgcacagaggttctatgttaattactctttctctatttccctgtcttgataaattgactgtccagtgcactaccacactaattatttttgtgtgtatatgtgtagacaaggatcttgctatgttgcccagactggtcttgatctcctgagctcaagtgattctcccaccttggcctaccaaagagctaggattataggcatgagctaccaggcctcaaatgtagtttatgaaaaaattcttagattaatgaggatcttataaaatgccttcaggggcttaagcctcctcccattttgtctaccttttgataaagtcccacagtcctatttggttttggtggcccaataaccaaaatagcttgggtcatatcagtgggctccccatacgaatacagctttaagataaccctcattcttactctcttcctgtaaattttcttaccatattttttgccctaagcccttcctacattaaaattctggatcatctagaattgtttcatcaccacaaagaaatgtcctgtattatcccttaataatcacaccctctttgaactctaaccctcagcagccaatgacctgatattatcactttgagaatgttttataaatgctatgtatagtaagtaacctttagactttatttatttcactcagtataatgcccttcaaatccctccatacatgttgtttgaattcaccaattcttgattttacagaggatatgatgaattgctttttttctttttattctaaaacaatttcaaacttacagaaaggttgtaattatagtgcagaaagtatttcccctaaatcatttgaaagttactcagtcacattttgcctaacacccaaatattttagtgtgtgtttcctacaaagacattccttgatgtaattcaatataattaccaaaatcaggacataacatttcattattatcatttaaactgtagtcccaatccaaattgtgtcaatagtccccataatgtccttttttagaaaaaggattcaatctgaacaggactggctactcagtggggacctggggctcacttcagaatgaatgtgagccttttgaaatattgttaagaattgagaggacaacagcagaacattaaatcaaacataggctcttccaagtacagggccctgtgccactacacaaactacatgcccataaagccagccctggtttaagatcatatactgcatttagatgccctgtatttttaatcttcttcaacctccttcttctgtcttcttttctctcatgaccttgacacttttgaagattttaagccagttatttagagaatgcctttcaatttgtgtttctctgatgcttcctctgattaaatggttttggcaggaatatcacagaggtaatgtttgtgattgcatcttatcaggtggtaatgatttgatttgtcccattttgatgatgttaattttgaacatttgattaaggtggtgtcttctagttttcactatggtgaagttacttttttccccaacttaataagtgtattgaaggacgatactttgagactatataaatactctgtttctcatcaaacttttaccacccactaatgttttctgcatgaattaaatattgggatgatagatgccaataggcgattttcatcaaatctattattccttttattttattaattaacaagattttccctctgcatatgtatatgtgtatttttatcacaaatgcattccaatattatttcataggttaaaatctgttgatatcattatttatttagatacacaaatttttccctatctgactagtgagagctcattcaagctagctcttttgttgttgtccttttgatatatccttatgattatttgagcacttccttattttcatgtaccacatgatgttaatggctcattttacatttttttcccttagtcctgaaattagccattgatccaaggagctatgttttattttagtgaaaaatgaccttcagaaaacaaaatctgaggctagacatgctcattattacatgggtgttgatgtctcaaagccctctcagtgagcagagcttgaggaggtaagcatgcatacacctgcaatacatacacacctatattctttctgtatccatctatatgcattaaaactttaagttcacacaaatatctccaattccaatccaatactagtgctagaagttttatcctaatttttctgcattttctataacttcctttttctataacttcctttttcaacctgagaaatcttgctcctattattcccaatatttttatttatttgataaatcctacctttacataaccaacatttcttcccctccacttcaccatgtgaatgctctttccacctcacccagacttcagcatttcactgttgttcattgtcaaccccctgctacaaaatcctcctccaggtctgaagtagaaatattcttaattatctcaggacatagtgtctgtggcagactgtgtggattgtgaatgcattcctcaccatgtccagtctctgagcccctgcaatatggtgctcctacctacaaagaatgtgttcttaccctccttgggctttgacgctctgtgccaagtcatggatatcattgctgtgccctatctccatgtggaagccatctgtgctatgcttgggctgtaacaaattacggtgggaccacaaccatcccacatgcagacagcctctttacctacttgggtttctgatatctcaccaagctgcttacactgttatataccccttacatagctgtccctctcacactcttgagtatgactactcagagctttgccaaaagaatgtgctcctcctcctctcaggtttcttacaccttttacccctcacttcctcaccccaccctcaatctagcatcccattatagtggctgtaccaccagtccattctcttcctttacccaccacccacatataaatatctcctgtgtctcattgcacaaggccactgtacctatctcccttccagcacgtgtttctatctagcatatactcaacctaatatcttttaggctaaatactcatgaaggagggaaaaaagggagagagattcatgaattagttttaaaaattcataactacgttctttataactagcagatactttgtcagtgtttggaaaaaatattcttttataaaaataaatagcacaagaaaccaagttttaagattatttttaaaaattaggtacttcattagacatgtatgaatgaatcacaacagtgaatatgaaggcagaatcatgccttctcccccaaagacgtctgggtcctaattctcaaagcctatacacaggtaactgtagaggccaaggtccttggtcccctgaagctctgttgaaaatgattgatatgaggcagattgattaataggaaaaaaaggcatacaaatttatttcacatgtatacataggagctttcggaataaacacctaatcccccagtaggggtgaaaaaaaaaaaaaaagaagcttatctaccatcttgagattacagaaagaatgagggctcagagcattgccaaaaatagattatgttggtaagtcaggttttagtggcaagacaggttatgaagggagagaagaggacgcttggctagcaaaggttgtcttgttatgtagatcaaacctcataggtagcagccttcagaagggacagatggtaaatatttctgtttcttttggaatctttaaaggtgccagactcttagttaatcttccctagatcaggacaaggtaaggcctagttgaattaatggagattctctatggttgcaaattttccctacaaaagacagttttgaagggccacttcagtctgctggctctgggacagccatctcaaaatatggcaaacaaatatatttttggataaaatattttcatttccttcattaccctagctggcaaatgggacttcacagatatgattaaggttatggactttgagatgggagatcattatggatcaccttggtgggccaaatctaattatataggtccttaaaagtggagaacctgtcctagctgtagtcagggagagatgagaccatggaaagaggagtcaaagaaatggaatgatgctgactctgaagatggagaaaggggaccacatgctaatgaaagtgggcagcttctggaagatgaaaaatgtaaggaaatgtattcttatctggaacctctagaaaggaacaaagccttggcaacaaagccttagcccagtgagacttatactggacttctgacatacataattgtataataataaatttgtgtgttgtagcaagacacatatggtaaaagaaacagaaatgctcagaggatatagtaggtgctagaaatatttcaatatttaagaaatattgaatatatgaattataagctgtttttgaaggagaactgatttttttctttcaagtctttatacttaagctgtcaagatgtttttttaaaaagccctgcattttatttccattctctttattttaaataccataaaattaaagataatttttaaaaattaaaaagccacaattctacgacactaaaatgatttttataaaacagtttcattctatcccttcttctttcagcagcatatatatttaacacaattgaaatcatataacattttcaataagctgctcacttttttcttctaaaatttataaaaactattttctatgtgtctgtaacatctttataattatcattttataactgtatgactcattgaattaatgtacaataattgattaatttatccttttgttgaaatttagtttgtttacaatgtttactatttaagataatttttcaaagaaacatctttgagaatataacttttttcctcttatttttttttttttagacagagttgtgctcttatcacccagactggagtgcaatggcgccatctcggctcattgcaacctctgcctcctgggctcaagtgattctcctgcctcagtctcccgagcagcttagtagctgggactacaggcacctgccaccacacccagctaatttttgtattattagtagagatggggtttcattatgttggccaggctggcctggaacttctgacctcaggtgatccacccacctcggcctcccgaaatgctgagattataggagtgagccaccgcgtctggcttttttccttattttctattttgacttaagattgtgtaaacccagaataaaatcataagcccctcaagtgactgaatggaccctgctttgaccaaaggcaccccagagaaatcagaaaaactgaattcctggcatattttgaaatggccctgcaaagccacctcttgtggggaaaatttgcatctgtagtgaatctccattaatacagccagggattcccttttcaggtcttccctggatccaggagggattaatgaaagtcacacctttaaggtctgaaaaagaaatttaccatctattttctctgaaggcagcgacatgggaacttcatctatataacaagaaccttggtctctacaaccccccttatcttaactcaagcatttctttcttttttttttaatttttaagctccagggtatatgtgcaggatgtgcaggtttgttacataggtaaatgtgtgccacggtgatttgctgcacctatcaactcatcacctaggtattaagctcagtatgcatgaggtatttttcctagtgctatccctcctcaaactcaaccccctgacaggccccaatgtgtgttgctcccttccttatgtccatgtgatctcattgtttagctcccacttgtaagtgagaacatactgtgtttggttttcttttcctgcattattttgctgaggataatggcttccagttccttccatgtccctacaaaggacatgatcttattccttcttatggatgcatagtatttcatggtgtatatgtaccacattttctttatctagtctatcactgatggggatttgggttgattccatgttgtattagtctgttttcacactgctgataaagacacacctgaaactgggaagaaaaagggaattaattggacttacagttccacatggatggggaggcctcagaatcatggccggaggcgaaagttacttcttacatggtaacagcaagagaaaaatgaggaagaagcaaaagcagaaacccctgataaacccatcagatctcatgagacttattcactgtcatgagaagagcaagggaaaagccagcccccatgattccattacctcccaatgggtccatcccacaaaatgtgggaattctgggagatataattcaagttgatatttgggtggggacacagccaacccataccattctgcccctggaccctccaaatctcatgtcctcacatttcaaaaccaatcacacctttccaagggtccctcaaagtcttaactcatttcagcattaacccaaaagtccacagtccaaagtctcatctgagaaaaggcaagtcccttctgcctatgagcctgcaaaatcaaaagcaagctagttacttcctaggtacagtgggggtataggtatttggaaaatacagccattctccaaatggaagaaattggccaaaacaaaggggttacagggcccatgcaagtccaaaatccagcagggcagtcaaattttaaagccccaaaatgatctcctttgactccaggtctcacatccaggtcatgccgatgcaagaggtagattcctaggcacttgggcagctctgcccctatggcattgcatggtgcagtctccctcccagctgctttcatgggctggtgttaagtgtctgcagcttttccaggtgcacgatggatgtaagctgttggttaatctaccattctggggtctggaggacagtggccctcttctgacacctccactatgcagtgccccagtagggacactgtgtgggggctccaaccccacatttcccttccacactgccctagcaaaagttctccatgaggatcccgcccctgcagcaaacttctgcctgggcatccaggcatttccaaacatcgtctgaaatctatgtggaggttcccaaacctcaatacttgacttctgtgcacccagaggctcaacaccacgtggaagctgccaaggcttggggcttccaccctctgaagccacagcctgagctgtacgttgacccctttcagccatgactggagcagctaggacacagggcactaagttcctaggctgcacacagcacagggaccctgggcctagcacactaaaccacttttttctcctgggcctctaggcctgtgaaggcaggggctgctgtgaaggtctctgacatggcctggagacattttccccatggtcttggggattaacattaggcttcttgctacttatgcaaatttctgcagttggcttgaatctctccccagaaaatggggttttcttttctatcacataggctgaaattttccaaacttttatgctctgcttcccttgtaaaactgaacacctttaacagaacccaagtcacctcttgaatgcttcgctgctttgatgtttcttcttccagacaccctaaatcatctctcttaagttcaaagttccacaaatctctagggcagggacaaaatgccaccagtttctttactaaaacataacaagagccacctttgctccagttcccaagtttctcgtctccatctgagaccacctcagcctgaattttattgttcatatcattaccagcattttggcaaagccattcaacaagtctttaggaagttccaaactttcacacattttccctatctccttttgagcccttcaaactgttccaagctctgcctgctacccagtttcaaagttgcttacacattttcaggtatcttttcagcaatgctccactctactggtactgactgggggagggagctccctttgcgctgcacagctcccaggcgggccctcactccgccctgcttttccgtgctctctgtgggtcatgtcaaccacctagtctgtcccaatgagaaaaccttggtacctcaattgaagatgcagaattcttttgctgttttcatccttctcagtgggagccacagagcaaagctatttctattcagccatcttagctgttcctcccttaacttttcttcaactatttctttctactgacttcaagtctttacacaaagcttaactctttcaaccaattgccagtcagaaaatctttgaacctacttatgacctgtaacccccacacctcttcaagagacctcacctctttagactgaaccaatatacaccttccatatattgattattttacttataattcctgtctctctaaaatgtatagaaccaaactgtatcctgaccaccttgggcacactttctcaggacttcttgagactgttatccaggccatggtcacccatattggctcagaataagtctctttaaatattttacagtttgttttttccatttacaccctgaagataaatttgtagaaataaaattaccaaaaaaatctatgaatatttctagaatcttcctgtgtgatctagctggctcttctgtttttctcaaattattgcattatcactggttactcttcatatgaagccaatagtatttgttagcattatagtactatatatatattcatacatggtcgagccccctttaatataaaaataatatttatctaaaaattattaaaactgtatttgttcaaataaattatgattctctggcaagtaaagagaaagaaaaataaaaccagagttctgacttcaagcaactcatagaccactgagagagtcaaatacagaggagtactgatagtaggagagtcagcagagagcagtgtagagtagtgcagcaatgtagcatagcggtaaaaagcctactaagaaagttactaaaacagaatgcccaattttgtcagtaacttcagatttagagcaggaaaaggactgaggagagatccaaataatatttctctttggtctttcaaaaataacaggctttctctttgttatgcaaaattttaacaaaagcgtgctgtttccataacttactctcctcattttctcccatgtagcaccagacatctacaattggagatttgtgttgtttttctctcattatcatcgttcattaaaattgtgtaatcttttctgcactaccagtcctcttgttccattgtcctgtcaaagtgttttagatgacctgtacgtgtatcttcttgccaacacaatatgcacaatattgcttttagcatgttaaactcacaatcaattaaagaacacaattaatcctgattgctatttcctaccaaaagtaagttttcatgaattataatgactgcaatcatgtgaatcattcatttagcacatatttacattttacctaatatctaccagggccagaaacatacacaaagaaagtggaaatagtccttgctttcaagtagactctcagtttgatgagccagacatgtaaacaagtaattgtgtttcagtgatagtataaagtaggaagaaatcaattcaaaagtcaattctaacctgggaccagtaaagtccaaaagagggattaatatttgaacttaatttgaaggttgaatacaagttctctatgtgaataaatcagataaaagaatatcgctagagggatagtttataaaaagtcataggtgcatgaaacagcccaatcaatttcaaaggttataataaaaacatactctagtatcacggttacaatagtgttctacatctacagttcatagtgttaccttcatatgcagaattttccccaaaactatttccacttcctcctggcaccttaattctcaaagtcgaattcacattctgaaactaacaatattaacttaactgaatcttttgataagtttctctgtggtcattttcattatattcccacttttcttcacttaattcatactgctgctatcatggggaacattgtgaacacttatcttaaatgacctgcttcttgctccaaatattgcacacacaagaaaatagttacttagctcccttctgtggaaaactacagaagcttgtcctcataaacaggacatttatgacaactctgtttgaaaggttggattattttgatatttcaaaagatgaaagtcttctgactgacaaaaagtggaggtgtagtttttttttttttctctttcgaagttttttttttataccaactgtaggtaccaacaaaaagaataatttataaacaaaatgtatcaattatttgcgttttctgtgaaattcttattgtagaatgtttttattttattaaaactacaaattcaaaataataaatagtaccaacggttagcatatctttgaagtgttgatctacatcgcttattcatcacaatttctgtacaaaacagagagaaagggcatataaaaaagaaaagtttgtcaggaccattttgcaatgatcaatgtagcagtgtaattaacaaacaaaaacactaataattatatatattgatataacaatattgtcatggaatcttggcactatgcattattccaatgtaaacatttataaaattgctgttttcagctcattaaacagtagttttctgtttaaatttcattcaatatatatgaaaaatgaacaaatataaatgaattgaatacaagttgcattttgatataaggagagctagaaacatcaaccttcttcattctgctcccttgtattaatgatacaatatggctatttggagaagaaggataaacgcatgaaaactgagtggggtagagcagaatatagagtttttaaaatacaggaaacaagtgcaactgaatcaaacagaattcgattattgaaaagcctaaaaatgaacataaataaataagcaattcaatgaaaacataaacaaaataacacttttctactatttttctttattttaatagaattgaatttctctgataactaaaacgctaaaggaaaaacgcttttacatacaaaaacaaaacatttagaaatactgcaaaaaattagtaggtagtcaccaactgtttagtgatgatttttcattattttctcctctgcctgaggcttgcaagtaagaagttaattaaataggaccaattctgcctccaacagttgttttcatgaaagatgcttggtaaaaattgtctttgccacaaaggataatgtttgagatagagctgcacatgtgtgcttatgagatagtgaccaatccattgttacatgtccccgaagtatgttagtaattggaccctggccctatatggattcagggatcctagcaaggcaagaaattccttctcttttccccaaagtttttacacaagtgaaacaaagtgaaatgagttgtctgaagcaggcacagcctcagccgagggccacatgcatactgatgggcctggttagtggtcatgaggaggtctgagacctcaggctaggataggttatgggagatgagactgaaatataaattgaagcatccactgtccttttattttattttatttttatctcagttcattaaagctacttcctttcccccactctatgttagatttgtatatgcaaaagaaatttgaccctctagtaatcacaactgggccctttagacaaatgaactttccatagattttacctggaagataatttaaggagtaattaacaatgccataatgtaaactgctgtcacaatttttccaggccacagacgtataaacttcagctgatccagggacagaaataaatgccagattagaactggtgtttttctttttgtctgtctctctaaaaaacatagataattggatgaacatgcttgccttgcatgaagttgtgtgagtgtatagaggtactggagaggaggacgggatggggaagggaatgctgtacaaatccagaactaaagccattgatccactccatcatattggctgcttctttcatctatttgcatccctatttctatggcccacacaccaatcatctgtaatatgtattaataaatccgcggtttgcatttattaatgttgttcatagatatttgattcttagctacttggggaatgtggatgactgaactccttgatctcctgattttagccaacgagttgagtaaaatgatgtgacagggtaaagccttccagagttttctttacttctagcacaatcagcaatgttcaagatgatggctgtttcattagactaagtccttgagtgactttggtgaatggattcccccaataactgatgagagatagagatgaaatgtaactcagaaatcagcctttctgattctcagttccaagacttaaggattgtttgatctcatagcaaacagctattctagctaatataattggcctatgactgtaatagtactttttatatgtttggggacatcttcatcaaaaccatctttaagagatagggatacagataaaccttatttccctattagcttttggttttgaaagttctttgaaataaatcattaatccttggttttcagactaagtacaaatcgtgaaactgctaagctttaaaaagtaatatttcttagggccaggagcagtggctcatgcttgtgatcccagttctttaggaggctaaggcaggaggattgcttgaactgaggagttcaagaacagcctgggaaacataatgagacctcatccctattaaaaaaatttttaagaaaaataaatttaaaaaacaagtaatttttaaattgacttacttaatactcactatgtgccagggactaatcttattaattattagtatgaactcatttaatcttcatattttgcaagtgaggaaatttgggcacagagactaagaaactttcccaaagttccccaagaagtaaaattttattttggtactatttactgtgcctcttttaccaccaccatgttcttaatacgcaaaggttttatttcttcttaatggataacatcaatgtattttcacttaagcaaatatttttacatttaagagaaagaatactcatttcagtagctattgattttcagctcttttgttatagcatacttcacatttttaaaactgtgtagttttccatgggtatggcctccatatttgacatgcgactgagaaaagaaattcagaagcttgtgctctgatagtgatgaacatacagaactttagtcccggaaccctaaaactctaatgattactttgtttggatcagatttgttttttttttggtaaaactggaacattgtctatcaaaatgaactttgatcgctttttcattatttaatccaaacgtgatacaatttctccttcaatttctaactaagaaggaagtgataaaagcaggtattacttggatgctagacaacagaaaaaggtttactttatattcctcctttgtagaaatagttgagaaacttttcagagcagaaatatttagtatttatcttttgctgaaatagctataaatatattttgagctaggcacaaggaccaatccttaattacaaagagagtctgtatgaaaatctaggcatttaagattgtagataccaagcttttgtgtatttatactcatgtgtgttctaagcttactataaaaggttttaaaagcatttagagtcactcattgagtccttatgtatataatttgaaagaatgcttttatcacactacttaagagtgtttgtgtgacaattaagagaagtgaaaaagtattctgtattaaaggataatatgaaggcaatggttatgcttgtttaaaattgtattattattattattttctgtgatccttgatgggcattgcactgttataatctgatgaatataaaagaattgatgggcattgcactgttataatctgatgaatacaaaagaactgatgggcattgcactgttataatctgatgaatataaaatgacaggaggtacaaagagttctcggaggagagtactactcttccttatgtaaaaataatactttctgtccgtaatcccagcactttgggagattgaggcaggcagatcaccaggtcaggagtttgagaccagcctggccaatatggtgaaatccgatctctactaaaaatacaataattacccgggtgtggtggtgcgcacatgttgccccagctactcgggaggctgaggcataagaatcacttgaacccaaaaggcagaggttgcagtgagccaagatcgtgccactgtactccagcctgggtgacaaagtgagactgtctcaaaaaaaataaaataataataataataatactttttataccttatacaaagtagtattttattctttaatataaatgccatgtaacaagacatttctgcagttagtttcttaacaattaattttcaaaactattccatgaatggtaagaatcactaaagcaatcagtaacacagttaacctgggaaaactacagagggaatgcaaattgaagagtaagataagaatcagtaaatttaagatctgagagaaactgaaaaattaaatttaaagctaataaaacgtgctaattcacattattattattcttggaaaactaagttgcttatgactgaaaattttccaaagtttcattgatcaagaaaattatctgctaataacagaaactacattaagacttacagcatctgaatattggctaaaacatgcatattttaagattccttttaatgtaagataataaacacaatacacttaggaacttaataattcctataaccagaactcaccaccttacccttacaagcagttgtttttattaacaaatatctttgtttctttcttccacgttgttggagatggcaggatttcactgacactatgctaagggaaataagccagtctcagaaggacaaagactgcatgatctcatttatatgaggtatctaaaattgtcaagctcacaaagcaaagagtaaaatggtgataacaaggggcttggggaaggggaaatgagttgtttaataggtataatgtcctagttatacaacatgaataggttctagatgtccgctttaagacacagtccctgtagttaaaaatactgtattgtacactcaaaatttgttgaaagggcagatctcaagttaaatcttcttaccataaagttttaaaaggtggaagtgcaggaggaagcttttggaggtgatagatatttttattaccttgattgtggtgatggtttcacagtgtatgcatacgttcaaacccatcaaattgtatgcagtaggtatatgcaggttttatatatcaaccccacccaaataaaattgtattttaaaaagcttctttcttctatgtatctactgtttgtcttcttataggcttgacttctttcttctaattcaatcttctggacccaaacaaaatagatcatataatgcagatggaaacctacctttcaaaacttattttctttttttttaattttttttattattattatactttaagttttagggtacatgtgcactatgtgccggttagttacatatgtatacatgtgccatgctggtgcgctgcacccattaacttgtcatttagcattaggtatatctcccaatgctatccttccccctcccccaaccccacaacagtccccagagtgtgatggtccccttcctgtgtccatgtgttctcattgttcaattcccatctatgagtgagaacatgcggtgtttcgttttttgtacttgcgatagtttactgagaatgatgacttccaatttcatccatgtccctacaaaggacatgaactcatcattttttatagctgcatagtattccatggtgtatatgtgccacatattcttaatccagtctatcattgttggacatttgggttggttccaagtctttgctattgtgaatagtgccgcaataaacatacgtgtgcatgcgtctttacagcagcatgatttatagtcctttgggtatatacccagtaatgggatggctgggtcaaatggtatttctagttctagatccctgaggaatcgccacactgacttccacaatggttgaactagtttacggtcccaccaacagtgtaaaagtgttcctatttctccacatcctctccagcacctgttgtttcctgactttttaatgatcaccattctaactggtgtgagatgctatctcattgtggttttgatttgcatttctctgatggccagtgatgatgagcgtgcatcaccaagtcaatcctaagccaaaagaacaaagctggaggcgtcatgctacctgacttcaaactatactacaaggttacagtaaccaaaacagcatggtactggtaccaaaacagagatatatatcaatggaacagaacagagccctcagaaataatgctgcatatctacaactatctgatctttgacaaacctgacaaaaacaagcaatggggaaaggattccctatttaataaatggtgctgggaaaactggctagccatatgtagaaagctgaaactggatcccttccttacaccttatacaaaaattaattcaagatggattaaagacttaaacgttagacctaaaaccataaaaaccctagaagaaaacctaggcattaccattcaggacataggcatgggcaaggacttcatgtctgaaacaccaaaagcaatggcaacaaaagccaaaattgacaaatgggatctaattaaactaaagaacttctgcacagcaaaagaaactaccatcagagtgaacaggcaacctacaaaatgggagaaaattttcgcaacctactcatctgacaaagggctaatatccagaatctaccatctgacaaagggctaatatccagaatctacaaagaactcaaacaaatttacaagaaaaaaacaaacaatcccatcaaaaagtgggcaaaggatatgaacagacacttctcaatagaagacatttatgcagccaaaagacacatgaaaaaatgttcatcaaaacttattttcaaattgtcttgtcctcatcttcccaatcatagagtacatcaacctgccctgtacttcctatgtcccttcactcactgacatttctttgtgaaatatacttagaatcctgcgtatcttttaaaacttagttaaaatgtcacagctgcaacaaaaacaaaagttctccattctttctagctggaattatctttctctgtccacttatcaaaaagcaattcattcttactccatccatgcatttcttctttgttttatgtctctcctctaagtcaagcaataaagaggttgaactcttttatttacttatgtcttacaatgatttgcaggtaaaaggacctgatagctgggtaagaggctcacatgtggaatctcagaactctgggaagtcgaggcaggaggatgacttgacctcgggagttcgagaccagcctgagtaacatagtgacacctacctctacaaatatttaaaaattagctgggtgtgatagtatgcatctgtagtcccagccactagggaggctggattgcttgagtctggaaggtcaagactgcagtgagccatgattgagctactgcactctagtcttggtaagagtgagaccttgtctcaataaataaataaataaataaataaaagaatcatatatatatatatataaatatacacacacatatatataaaatatatatacgcacacatatacttaaaaattaattttgtcttttcaaaactagtagtggagtctgagtgcttaatcattattcagtatatatattcagtatacatattctgtatatatacacatatactgaatatatatattcagtatatatattcaatatacaatatatatattcaatatactatacatacctattgtatatacattatatataatatatcctatatatacatatatacaatatgcatattcaatatacaatatacatattccatatacatatacacaatatacacatatacagtatatatattcaatatacatattcagtatatatgtatacatatacacacacatatactgaataatggttaagcactcagactccactacttcataaccgtgattttagatatgtgcttaacacctttcagcttttatttcctcatgtatagcatggtgacaataatagtgcccaccttataggattttcttgataattaggtgagatactcaatgtaaaatcacttgtcacaaagctccgtgtcataaaaaaagtctcagtcattcaaagtatgtttctgactacaatgggattaaattagaaaaattagaagtcaataataaaaaggcatgtgggcaatacccaagtatttggaaattaaatgagagatttctaaaacaaatgagtcaaagaagaaatcaaaagagacattcaaagtattttgaattaaatgtaaaagaaaagccaacatatcagaatttgtggtatgccagttcttaaagggaaattcatagtgcaaaatgcctgtgtaagaaaagaggaataacagcaagttagtgatcttatcttccaccttcagaaaccagaaaaagaacaaataaaactccaagtaagaagagaaaaaacaataaagcagaaataaaaaattttgaggctggccatggtggcgcacacatgtaatcccagcactctgggagactgcgctagaaggacagcttaaagccaggagtttgaaaccaaccaggcaacaaactgagtttccatctataaaaaaaataaaaaagcttatctgaatgtggtggcatgcacctacctgtagtcccagctacccaggaggccaaggcaggaggatcatttgagcccaggagttggaggctacagtaagctataattcactgcacaccagcctgggggacagagcaagtccccatctctaaaaataaattaattaaattaaatagtaatatatattttaaaaaggttcttttggggaaggaggcaaaaaattctttatatataaagcatagattacatatacataaatagacatacaatatgtctctgaaattaaaatttattgggggcaattaagaaaaaagtcaaaaaagactcatagggtagtgactgaaataacgtttgaggaaaactgttctacggatattaaaagaacaataatggaatattatgagcaacttaactagaatacatacaaaaatctggatgaaacagacaaatttctcaaaagacccaaaccaccaaagttcactaaaacaaaaaaataaataagaagaatagtcccacatatttaaatatatatttttggtaaaatccttcctaccatgaaaacttcagtcccagatgccttcactggtaaattctactaaatattcagggaaaaataattatacaaattctataaaaattccttcagcaagttgacaatatgggaatacctaccagttttttctttaaggtcaacattacacattactgaaaccagcaaagacattataagaaaagaagattacgtaataatatccctcatggacataacaatgttctgatgaaaacaccagcaaaacaactccagatatatataaaaagataataccttgtcacaaaagtgaggaatataccaagaatgtaaagctggttcaacattcaaaaatcagtcactctaattcaccatattaacgcactaaaaattagaaatacgtaatattatctttttgaaagacacagaaaagcatttgccaaaaatcaaacattcatttctaattaaaaacgaaaacgaacaaaaccacctcagctaattagaaacagaagggtatttcctcaacctgaaaaaaaatcaatcgtttaaaaagctaacactgtacttattagtggaacactgatagtgttcccccgaagatagtaaaaagacaaggatatttaccctcatcactgctgttaaacattgtactggatgttctagccagtgcaaacagagaaagaagataaagaactaaaaggcatccaaagtagaaaagaaaaggtaaaactgtttgatccagagatgacatgatcatatatgtagaaaatccattggatatacaaaaaagcttctagaatagatgaatttagcaagacttgccggatgcaagatcactatgcacaaatcaattgtatttgtttgtattaacaatgcacaacataggactgaaatagaaaaataccacttaaattgacataagtatttaaatactgtgggatatgccaggcatggtggctcacacctgtaatcccagcactttgtgacctgaaatgggcagattacctgaggtcaggagatcgagaccagcctgaccaacatagcgaaaccctgtctctactaaaaatacaaaaattaggcaggagtggtagcacatgcctgtaatcccagctacttgggagactgaggcagaagaatcacttgaaccagggaggcggagattgcagtgagctgagatcgcaccacttcactccagcttgggtgacagagtaagactccatctcaaaaaaaaaaacaatactgtggaataaatctgatataatatgtaaagtactgggacactgaaaactgcaaaacattgctgagaaaaaaattaaaagcttaaataaattgaaatttttttttgttcattggtcagaagatccaacatgcttaagataacagttctccacaggctgaactctatagtcagtgaaatccttattttttaaaaataattattttataaaatatgacaagatgattctaaatttatatgaaaataaaaagtatacaaataactacagcaaaaatatatttgaaaagatgaaaattttataaatctatagtgtcttagttcagattgctataaagaagtacagtgggctggatgacttaaaaatagcaaaaatttatttctcacagttctggagattggaggtctgagatcagggtatcaggatggtcaggttctggtgagggccctcttctattttgcagactgctaacgtctcattatatcctcacatggcagaaagagtgtggactaactctctggtcttttcttataaatgcactaatctcattcataaaaggtactacaattcatgaactaatcacctcccaaaggccctgcctccaaatatcaccatggtggagatcagcgtttaacatatgaattttggaaagacagtcagtcgatagcatatagtaatcagaacagtgtgctattcatgtaaagatagacatatagatcaatggaatatgatagagcccagaagtagacctttactgtatatgaacaattgatttttggaaaaaatgcagttagtctttgctgagaagctctgtgtgcatattggggcatatcttcaacactcagtcaggtttttctcaaatctgcctttgcctttacttcctgtttgcataaagccacaagattattcagtgatgagaatttaggaccttcttatgtctttcctaagaaggagagaacactgtctgcctgtgtgtggccttcaagattcctgggaatactgctgagtttttcaaagccttaggaacatctaatttccagcttttacttttaagctttttgtttatactattgtttgatagaaatattatccactgccttaggaccataaagttaaacaataattccctgttgtgtttctttgtttgtttttaccaactcctcccctcccctacctccaggaaaaggctgttcatgctgggtgagctctaagtcatgtcagtatagatagctttgcaagtggggtcttccatgaaattaccaggtaagtcagacaacggtaattatttgggaatgagctctaaccgtctctgttgtctctagtgcctgcactattgttgctttttactgcaaatgtgggctattatttttcaaggctaccccacagctggagaacaagtgatgagaataaagctaaaaagcaaaaaaaaaaaagccataagttcttcctaagattcagtcacttttcttgaatgaatactccctgagttactacaagactttggttaatttctagagttctcaaataggtggattctaactttaaaaatatttttactcattggttttgtggaagaaaatatttatcttttaactttcatttcaggttcattggtatatgtgcagactttttctataggtaaattgcttgctgtgggagtttggtgtacagactttcatcacccaggtaataagcattgtattcgataggtagtttttctatctctcccccttccttctcccatgcttcaccctcaagtaggccctggtgtctgcaggtcccttctttgcgtccatgtgtactcaatgtttagctcccacttataggtaggaacgtgcagtatttggttttctattcctgctttagtttgcatcagataatggcctccagctccatccatgttgctgcaaaggacatgatctcattctttgttatggctgcatagtatttatatatatatacacacacacacatatgcacacacacacacacatatatatatatatcacattttcgtcatccataccaccactgatgggcatttagattgtttctatgtctttgcttattatgaatagtgctgccatgaatatacgcatgcatatgtctttatggtagaatgatttatattcctctgggtatatacccaataatgggattcctggattgaatggtagtcccattttaagttttttgagaaatctccaaactactttccacaatggctgaactaatttacattcccatcagcagtgtataagtgctcctttttctctataaccttgccagcatctattattttttgactgtttaataatacccattctgactggtctgagatggtatcttgttgtggttttaattttcatttctctaacgattagtgatgtcaagcgctttttcatgtgcttgttggtcatgtgtatgtcttctttggaaaactatctgttcatgtcctttacttactttttttttttttttttttttttttttttttttgagacgagtcttgctctgtcgcccaggctggagtgaagtggcgtgatcttgactcactgcaagctctgcctcctgggttcacgccattctcctgcctcagcctcccaagtagctgggactacaagcgcccgccacctacacccggctaattttttgtattttttttttttttttttttttttagtagagacggggtttcaccgtgttagccaggatggtctcgatttcttcactttgtgatccacccgcctcggcctcccaaagtgctgggattataggtgtgagccaccgctcccggccgtcttttacttactttttaatgagactgtttgttttttgcttgaatatttaagtttcttaaagatgctagatattagacctttgtcagatgcatcaattgcaaatattttctcccattctgtaggctgcctgtttactctgttgatggtttcttttgctgtgcagaatctctttagttaaattagatcccgtctgtcaacttttgtttttgttgcaatggcttttggtgtcttcatcatgaagtctttgccagggcctatgtccagaatagtattttctaggttatcttccagagtttttacagttttaggttttacatttaggcatttaatcaatcttgagttgatttttgtatatggtgtaataaaggggtcgagcttcaattttgtgcgtatgctacacagttatcccagcacattattgaataggtaaccctttccccattgcttgtttttgtcaactttgctgaagaccagatggttgtaggtgtgtggctttatttcccagctctcaattctgttccattggtcaatgtgtcttattttgaacccacattttctcccaataattaattgccttatttcccctctgcacttcagcttccctctgttttatcttcctcttcatcctaaaatagtgttccatcatttcagccagattatacacaataacatcaattttcatatttctttatttatctgcctccccattccagagcttgctacggaaaacctaaacctagatattagtattaccatatagatgtaattgtccattccaatgggttctcagtcaagccagaaaaactgtgtacttttctttgattacatcctcctctaattactttggtttagatgtttttccaaatttttgccactgttctaaatatttacatccacttcactgtaaatatgagcatttctttattgttttcagagaaaggagaaaccaccttatgggaatttgtataagattcctgtactgtattacccttcaggcaagaatttatctttatctactcataatccatattgcttctttccatacacaagctataacttgtcttcttaccaactcaaagccgtttcttttacctgttctctaaactcaaggtcctctgtcacaagagtcacgtaggataagtaaacacaaagtagttgtggtaaacttattagaaacaagtattttcattttggggaatgattctggctagtctccaaatctgcatgtgtttagttgagtacaataatgtggtagggagaatccatctgcagttgtgctaaaggtccattgttgtcagagggtagagtcgggtaggtaatatgtaaaatagcaagctctcactcttttttaccctctcagtaatcttccttgcttcttcaaaaccttcaatgactataaatgccctttaaaccggtttcaagcttttcagtttggtgtttgattctatgcagctttagttgctacttacatttttccactgctatttcctgaatatatctcccaaagctcatgttttgtgaactttatgctcaatgaaacagtttggtggagtggggcctttaagatgtgattaggtcattagggctctgtcctcatgaatagattaatctgttatcctgaaagatgattagttatcatgggagtgggctcctgatgacaggacatgttcagccttcttgctcttcctgccttgcacactcactaaccatgtgatgcctttctattatagggtaacatagcaagaaggtcctcacaagatgtcagcaccatgctcttggacttccctacttctagaactgtgaccaaataaaaccctattctttataaattacctagcttttgttatgctgttacaacagcagaaaatggattaagacacccactcacatatattttcttctttgtctttttaatactgtgaaacagaattttttagttaatttagttattcttatattagacttttccatttatgaaagaatgagttcttacaatggacctctttgataccattgacttgaatgtgtaataggaagaactctaaggcttctgaaataatccaactgtttatctgcaaaaccacctgcagccagaaagtgagataacaaaatcactgaagaaatcaaaacatgagagttgaatcacaaaacctcactttatcttgatgattttctatggaaggtatatacctcagcacatcgataaaaggacaattttgtgtactaaaacaaaggaggtcattataaggatataaaaaccaatggtgttaaaagcagcactaatgctcagcagactaaaaccaagtaatccagtgtaataaaatggttaggttggagtcttaatagattgtaattgttaggagaataaatcacagctaaaatatttctctatctatgagataagcattggaaataattttaaaattcagagacctcaacactaaaggtagaaaatatttcctttcctattagagtactaaaaaagagtaactgaaatgaatattactaaactaacattttttctatttaagtgttttgctatcacaaactgaaagaaaaattaacgtttcagattatttaggagaatgagccagggattgcaaatatctcacctcaaatatcgtttttgttttttgttttttgtttttttttttttgagatggagtcttggtctgttgcccaggctggagtgcagtggcacgatctcagctcactgcaacctccacctcccaggtttaagtgattctcctgcctcaacctcccaagtagctgggactacaggcatgtgccaccgcacccggctaatgtttttgtatttttagtagtgacggggtttcaccatgttagccaggctggtctcgaactcctgacctcaagtgatccaccctccttggcctcccaaaatgctaggattgcaggtgtgaggcaccacacccagacactttgcaaatatctttattattcattatatataatagattgttctatagtacagatagttaaaatggcttaagtaacaaaaattaatttttgattaaaatattaggaagtataaagtagatcagtcaaaaagatatgaacataactgaataattcagccagccaaatagcacacactggacaaaattgtctattcaagggtaaaagctggactgacagtaaagaagagttcacaaagcaaaaactgttgctcagaaagagttaatcattctctgaaaaatacaaatctagtcataatttctatgcagaaaaagaattgcacccttacagataaacaatacagataggtttctgctttcttgttttctatcaatctatctgtaattgtgtggcattgagaatatgcaaaagtaattgctagaagatgcagaatagttcagagcacagactctggtgtcagtaaaactttccaacagtataatttactagcaatgtcactgtgggcatgtcacttaatgtttaaacttaatgttttctgttctgtagtagtgtagcagcgtcactgtgggtatgtcactttatgtttaaacttaatgttttctgttctgtagtcaggtaatagtaatagctcttatttcataggattattttcaggattgaaatgaaaaagccaaaattgacaaatgggatcgaattaaactaaagagcttctgcatagcaaaagaaaccaccatcagagtgaacaggcaacctacagaatgggagaaaatttttgcaatctactcatctgacaaagggctaatatccagaatgtacaaacaactcaaacaaatttacaagaaaaaaacaaacaaccacatcaaaaagtgggcgaacgatatgaacagacacttctcaaaagaagacatttatgcagccaacagcacaggaaaaaatgctcatcatcactggccatcagagaaatgcaaatcaaaaccacaatgagataccatctcacaccagttagaatggtgatcattaaaaagtcaggaaacaacagatgctggagaggatgtggagaaataggaatgcttttacactgttggtggaagtggaaattagttcagccattgtggaagacagtgtggcgattcctcaaggatctagaactagaaataccatttgacccagccatcccattactggggtatatacccaaaggattataaatcctgctgctataaagacacatgcacatgtatgtttattgcggcactattcacaatagcaaagacttggaaccaacccaaatgtccaacaatgatagactggattaagaaaatgtggcacatatacaccacggaatactatgcagccataaaaaaggatgagctcatgtcctttgtagggacatggatgaagctggaaaccaccattctcagcaaactatcgcaaggacaaaaaaccaaacaccacgtgttctcactcataggtgggaatcgaacaatgagaacacatggacacaggaaggggaacatcacacaccggggcctgttgtggggtgaggggaagggggagggatagcagtaggagatatacctaatgtaaatgacgagttaataggtgcagcacaccaacgtggcacatgtatacatatgtaacaaacctgcacgttgtgcacatgtaccctagaaatatatgaacaaataaaagaaatgaaataatgcatgcaaaacatctagtatatagtaaactaactcttatgtaaatattagctattattttattacatataaataaaaagggctaagacaatataaatcttgatgtgttctcaaatacagcatttctttctaaaatgatttttcttctgaatgtctgctaaaatttctggatttcctattgaaattctcagttaatctactgaaacaatctcattcatgtactgaaaggacccttcctccataccactgatccaggagaaacagtctgtatcaattaccactctgttccttccatgcctgcactttgaccctggcatggcgtcttgatttttccttagcaggaacaataacagctttggtattctggtgtgaattatttatatgcttgcttctagtttggttcctccagcttttgtcccactctcagtgaaaagatctagttgcagacctcagatcccacaaattgagaacaattttcctgtaattatctgtgtatagggtgatctggttatactataatgctcatgatcttaaaggtttctgtggcaaacaaaatattgagactctatcttttgaaaagtgggaaataatttaagatgctttcacagaggaatgaaacagctttaacaaattcagatgagttgaatggactagaagcaggactgccccatagaacgctgttttaatagtccaaagtataaatttaggagaatgacaactagaaatagaaaggatgtgaacatcaaaagaattttcaaatatctttgatggagtcatgattttgaaaaaataccttccagtgtcacctttattccatagtcagtaaatgtgtagcataataacatgtagtaatagaataaaattatttcaaaaaaaaataaatctagtggttttctttaaagtcttatctgctactttcttaattttattaaagcagacaattaggatttcccaaagcaaaatattgaaattgccagtatcagctgttgcagaatgctttatttatctatgtttgagcttgaaaatgtactctgatagcatacatttttttcatttatgtttataatagtttcagagtacatggaaaaatggaagcttgaagttggtcctagaagtccctattacaagccactttaggcaaaattcctagtgtatcaaactaaacacagagataatatattgtataaatgtatacttcctaggtgctccaggaagaaaggttacaaatatagtttcccatctgagaggagaagggttatataaatgtacttaacttttaaaggtaactataattttgacacgtaatttatgttttatacttttaaactcaaagatgttttctttcttagaaaatgcactctccatttgatatgataccaccaggtaatcttaatatagcatgcctatgtaaagttaggtaaattcgttctgttaccgaagcttttaaaattattgtcaacccctttaaacaatcttgttttggacagaggaaagttacacaaaattggtttcaaatcaaaccagtttctgcctaaactggctcagggatttatgctgaatttaactttctcaacggcttcccattaatcttgttaaaagtaaaaccttacacaaattacattcaacagagtttaattgagaaaagaacaattcacgaacctggcagtcaccaaaccagaagtttagggaggttccattgctaccacatggtcaaagaagatttatgaacaggaaaaggaaagtgacacacaaaaaaacagaagtgaggtacagaaacaactggattgtttacagtgtggcatttgccttatttgaacatggtttgaagagctggctgctcttcattggccaaaacttggtgattggcataagagtaggttacagtctgttcacacatccagtcagggagcagttcactatgtacagagaaacctttaaaatatataaaaacctttaggctaaacttaatttaacaactctcttcttttggtcaaactctcagttgaaagatagactaaaactttggatgtcattctgtcaccatcataaatgtacttatttggtctcaaatcccactggaaaatagcaggacgataggtcttgcaaagtgagaacaaggacttcaggttattattattattttatataagggttagagtcaaaggaccttcttgttctggaatctcctgttttcaggagaaaaaccaaactccatctgttttaggatttgttttcttaaagtgtcagttcaattacactgcaattagcatgagtgacttcattttggtttagtctggtctctggggcctagaccatgaaccagtccaaaacaataggttcccataattttgtttaaaaattaccccttttgttcaggttctcacataggtgagagggtgaccatgcttattcaccaatatcttgggttttcagtctcagcatgtaatttgtaggttacagggtcctcatggtcatatgtttctttgtttgtttgtcattctggttgaagagtaacaatttgacattctacagatggctgcatgcaaacatttaaaacttctgagagaatacagtgcaccaaggaaactaccgttagactaccggcagggtaataccaagagtttgaagtatgctccttatccagggtcctcaagaatcaaacctattaaaatcaaatagaccacggaattagctgaagagtctagtcattttaaccaaccatcctgttattaattgcctacaactcaatctccataatacccaacccaatgtattcttccatgtccaactagaagtgtcagcacctgttcatatacttctgtttagccaataagtaatctggagcaatcctattatttagcaaaactttcaaaagatttaagtctgttgtgtagctgtagtttttgcagtagaatctgctatacagcctattataagagatacatttctaaccattgcttcatttactccaaaccgtggagaaaaagacctaacaagtggtgcccattcagaaaagtgaaagccttctgccaatgctctcttcaacctatgctggcaatgttctctttagcctattttgtgggtaaagaggagttggaccagtgttctgtttctgatggattataaagcaaccaagatcccattaaacgtttttgcttacattggccctttattttttatctttcaaggcataagctcatccatatatgagactggctgtgaaatcttccacaaataaaagtattccccaagagtgcacacaagagaccccctttttagttctatcattcacagaggcataagcaaggacaaaattgagcgatgagagcctcatgatagcagagaagtgttgatccgtgatcttgcgaaaaagttgttcatgtctgggataccatctgcttctggagagaaacttccctggttatctttaccttaaggtttctaaagtgcataaagttcctaaagtctggaggggccctactaagttgtgaggttattaacctgaagttcaaggtcccaaagttttgctttagtgtgggtggcaagggcagcttttctctaatgttctcagaagacttaatctctgtattctatattatgaagagtttgcttgtttgttctctgtcagtggattattaaaagctttcttcacctagtgaaaatacattttgacataatgcattaaagccttacaacatttagtcctatcagagtttagtagcagaatgtacatgaggttctattattaggtgcacaggccttccagcgactatttcataagaggtcaacttatattttccactctaagtggatccgattatcatcaatctgcaatacctttgaccaaggcaatccagtcaattcagttagctttgcaaaatgttaatgtatctgtaatactgtatttaattattttacaacttgtccagtgaaacaagtacctctatcattggagatttctccaagaatgtcccatgagagaaatacattttctataaccttttagctactgtaatatcatcagcactcatgcatgagaaactttctatacaaagagaaaacatgcactgaatacgataattgaatgaaatccttctacacatgtttaaactgcccatcaggtagcagaaatgtacctgaagttttgattgtctcaccaggattttgggtttgacaaaacaaacattggccataaacgattttaacaatttagaacagtgaccacacaatatatatatagatatagatatatacagatatgtatgtaatatatagatagatatgtatgttacaaatatatttgtctgtatatatatatatatttgtgtatacatatatataatatatatataatttggattattttatctctactatgatgagtcattaaatgtagaactttcaataatgaaagacttgaggattcaggaaggaccagatgggtgtccaggctctccatgagtccacagttaaatcctcttaaatactaattttgtttctccaattcaggtgcagagtactgttcattagatgggttactacaggtaatttgacctgaaccatgaagttttcattcaaattgcatatctaaataatttcagcaccggctaatttagcatgaaaatctggcaaaatattttcttggtttttaattaatttttgtcctgctttggttagcagttttataaaccagccagtctcttcattatggttctgggaactgttacccagtcaaaatgatataatcataaagttactagaaacttgttgtatgcaaggatttttgtcaaagtccttttcatcctttctaacagttctccttgaagacaccataatctaggattttactttctagattggttccttgtgaagagttttcagaaaccatatcagaactaaacatttaactgtggaaatggcttgaaatggtcacagttaaaagacaaggaaatttggttatttctgtggtctataataatttaacatcataacgatagtttcaggtgatggtatatacacagacatctcagaatgttaagaatcccgtacaatattgaaacatatattaataacattaataaaagtataactcgaagattaaacatcacttcttattcagcaatgtttccagtgtaatttaatatgtcaaataattctgtttatcattcttttggatgcttcaggggctctcgaagcactgcaaagtgagaggtgaaaaaatttgggggttaaaatttgattttgggatgactgtcaaatatatcaaaagtttaaaacacttcaaaataggatcacaggccactgtaaaaaaatagtcattcatttagctaaagtgataatacaaagattttaaaaatcaaaaatgtttactttgtcatagagaggagactcagttttgcaaatattcaaaagacctgagaatgacagcatgagagagaacctgactttccttcattcttgtctcttttttaattttttgcagtttactaaaaaagtgaacaaaaatattttcctgtcacttactaatattacacaaaatgtttgttcaaaagagaaaatcaaattttacttttgtattagtgtattatcaatactaaagccaattttaatagaactttataaataaatctaccaaatctgacatttttaactatacaagatttttataaacttttaaaaatctacttatttttaaaaattatttctcttcccaaatttctgtatttatttaattttatctctgttttgtatcccttcaatttataactacctttaagtaaatttttaaatggtgaaaattatttttaacatacatttttatgcctttacaactttcctcattaaaagcatatcttgcttgtttcaatattgtatgggattcttaacattctgagatgtctgtgtatataccatcacctgaaactatccttatgatgttaaattattgcaggccacagaaataagcaaatttccttgtcttttaactatgaccatttcaagccatttccacaactaattgtttaattctgacgtggtttctgaaaattcttacataacaagtcatacatttgttttgcctcacttgtcaattttgaagccattcttattttaataacaattcataaactagctttatttaccaaatgttatcacacacacataacacatatagacatacagacaaacagacagaaacagatcttatagctttcattaggattctcatttgctggcctggctggcttttaaatattttaaatatattttccccccattcagactatcaatttcccaaatatctacttcattgtcctaagcagctggctaggacaccctaaatttgcatttctaaagggacaactcttaggtgaaacaaggtagaaaatttgtttctcaaaagcatagagctaagatgttaggcttaaatataacattatttgctcaaaccaaggaaaaaatggtgtaagtaaaagttcagttgaggcaaaacaaatgtatgacttgttatgtaagtttaaaacaatggtaagtgtttccaatacagacaggcagatacccttacaaatgaaaatgtcctttacagatgtaaatctcttttccaaagggtttcagcagagccagttataatgtcagaaaggggtatcttaaatagttggtcattttaatttaggggctggttcttagcttaaattattgaattcagggtggaggccattaaggaataggacaaagaaagtgttctccatgcctggactcagcatggatagatccgaaaaacaagcaaacctaatttacttgagggccttataaacactttatctaggatagctttctttttgtctttggggtgggatagtaactatgccaaagtgttagcagatttaatttttcttaacaattggttgcttaagcttttcattggccttttataagaagtcaaaaaaacctacaaatatggaaatattcttagaagcttctacacatcagtaggcatccctggatgagactaattcaggagccctcactttcaaatgcatttcttaaagtgcagtattgtgcgtttggaacatttcattgtcacttaaaattagctttagtaaaattttgtcatttctataagcatttgctgctcctggacctaatacttatacatgttttgtaggcatagtcagaaggtacattactcagttcttcagaaattaaggattccattgttaccttgaatcttgactttggctcttagatttccttgaccaacttagtcaattatttttccctacctatgtgtgcaagaaaaaagaaacaaagaaggtagaacagaaaaacctctgcaaacttttggaagctgaagtttgctccccctgcggtgttaccattacaatcggtttctgtcagacccagtcaaacatatgaggcctctaattggattcaggccaattattggattcgatctgatcctggacccagtccagtttctactgaaatttccaaactcagtttggaacagaaatttgctcaaacttggatagctcaaaacataaatccgtggagcttcagaatcggagagggagctatgagagaccaatggacacaatgggcccagtaggtacttccctcgatcactcaggactcctggcggttgctgaagctctacttcagatcccacctctgatgtcactgaaaaaaacaaaaaagccttagacaaattaaatttaacagactttaaagccaccacacctggaggaattatgctgtatttctgcattcaaaagtatacattgtattttcctttcctttataaattcatttttttgctttccctagtctcacattgtcatattttgactatcattttacatttaatacataatatttttttcttgtttgataactttaacattaaggctatgaaataaatttgaagatatattaaggatagtttttctagccatgtttatctgaaccatctgacaaattctggctccaacccttagtggaatacactgttctacattaagttctgaatttttggataactcctttctgtcaatgctttatgatattcacaagttttactttatatatatgttccccatggttttagggattgcaaaaagcatttacttctttcacaagtttattcaaagcagaccactaaatagagcatttttcattattgttaagaagagaaaaatatggctttaacttattgaattactgtaattaccaatttatgttgaatatctcctggtttttcaatcagtcctaaaaaaattcaattttattatatggaaaaaatatttctgagaagccagataacataattttaatgagcaaaatccattagataatcaatgtcatatattcctttttgatatacacatattgtgactttttgttttcattttttatttggacaatatatagagtcactggaagttgcaaaactcgtgcagagaagttttacatgcacttcactcagcttacgccactggttacactttacaaacaacaaaaaaaactcaactaggaaaacttttaatgatgatagcaaatgttattcttctaattatattctttcctcattttctatgtgtcccaaatgattttacgccattttagtggttgtattaaaatagaaaaaaggattgttcctctagagttgatttttcaataacattctttattgttattctatttttctttttgttttaaatacccctgcaaatatgaaatagttctttttctctggagtgtgaaatttttacacacatgatttgatttaattttaatttataacctaacatttcaggggaattaactatgtcctacctttccttgacttccaagttgtataacttaaaggcttttttaaaaatagcaaacaattatccacctagtgtcaaatagtggagatggataatatagcaatgtgatttaaaaattgatcctggctctactcagctgagcgtaaaagaaaatatatgaccagctggagagacatagtaagcctgcagcatatagtacatcactgccaaagctagaaaaggttttaaaagacctttctgctaaggaagtttgctatctgctatataatcctagccagactttttcctgaccttgaaaaaactaaaagtataatcaatgatcatctaatagcagttgttcaggcattgtgtatggtgtgcactttctgctgaaccacagatgatgtttacaccatctgaagaaaccatactgtcagacagtcagtaaacaaagatttgtctctctggaaatgccacagactgtaaataccaaactggccaaccatggctattttagaatccactcacattaaaaataccattatatcctaactataaatttaacctatttgtgattctgcaaccattagtaggattatggtttttgaaggaaaaaataaccagaacatttgttatattatttgccaatggaggcatttaagaccatatccaaaactgtgtatagctgccaaaaaggtcatgctgaagcaaaataccaagttttatgattcagaaaggcataaccttttgaatgagcttgactgaagctgagaataacatttatatgcatattgatgcttaagatatgtggggtatcatcgaatcaactagaaaaagaaatccaaaaggttacctgatccaactgtctggtttctagctgggtgattgtaaagccaacaaaatggaggagatatttaatggtgacatttattcattgactcaacacactttcattgcaaacactgataacttgttaagcactgcattaggtgccaggaatacagaggaagtcatacactttttcataatctaggaggaaaaaaagcaaggcgcaggagtaatcagagagtcaattatttctgaactcttgtttttttttttttttttttcaagtagttctcatctaagtagttgttttttgtcatgagaaaatcagatatgttgctaaaaattcacaactattgcaagaaaaaataaaagacaatggaggtcagaaaaaattacgggcaagtgatacaatgtaaagcagccacgaagggaagacaagcctccataatcattgtaaatcggtccaataagataactgcaacagaaatagctgaagttctagacatacatttggtgaaaaagttttatacacagcgtaaactttgctaaattgcagccaaaggcgagaatgcacaaaaataagtgcaaatgctatgaaacccagatatgattgttacagcacagattaggtcacgttgtggcctgggccataggaattaaaggcacatcacagagctagatgaatgacacagagcaaagaagatctctgggaggcttttaccttggtcaaagcttcaccaacatattaactgagaggtattggaagtttgttatacgtacattttcttaacacatacataatgtttacaaaaatttttacttcagttttagctataataaaatattatgtcctcaggcaaagtgtgaaaatcagagggataccagtggagaggtgggcagagctcaggctgcctgagcgctcacccctcccttcatgagacaggcttcaatatccaggtctcatggggcactatgtgttcagcaatacagtctgcttcctttttttttttttcatggaacggggggaataagaacagacagaatgaattgttgctatgatgaatccaactgaaacttacgttaactttctggtgcccaggttacacagtctaggggaacagaggctcttcaacaataatttgctagccttttctttaaaaaacaacttatatgtgcagcacatatctttatataaattaaggtgttatagctgtttttaaaagcagaggatgctttgcctggcacataagaaagcaggaaatgaaatggtaagcagagctcaaaaaggaaagaaacctttagggaattacttcaaaagtaggctacacaagaggagaacactagaaataatgtcctgcgttgagcaattctaaaggccaggagactctcaaggctttcctttttcgcaaaagttttcttcttcatagtaggtaggtaagaaaagattgcaaaagatgatgacagcaactagagctgtttagagtacatagcatacctgtatactttaataataaaacattaaaagatatatttttattaaaaggctctaaagggaaaagagaatcccctgatagataatatacagagtaaataatgcaccaaatcatatgaaaatataaaacttagttaattatgtgtagaatcttaaaaagagtattttataatgcttttactgttttaatatagtaaagtagatattacatctatttttttgtacctcattgaccatgcctagccagttttttcttttctttcattttttctttttgctcttgtctgtattatttctttattgttgttgtaatagtcataattctaaacaaatttagtatcaccttatggtttaaatagaatgttcctttctgatctcagtctctttttgttctactaatcttatgcattctccagattgatgttattaagttcagctttatatgcatcaccttcccactaaaattgtcttcatgcttttgtcattcctctaataacattcaaaaaattgaatgcacggagatagagagtagagtgattgttaccaaacgctgggaagtatagtggagaaggggagcaaaagagggggtggttaattggtacaaaagtacagtcagatagaagaaatagtatctagtgtttagtagcacaatagagtgactacagttaacaataatttattggtatttcaaaataactcatagagtatagttggaatgttcctaacacaaagaaatgataaatgcttgaggtgatggataccccaattattctgattggatcattacacattgtatgcttgtattaaaatatcacacctacccccacaaaaatatatacctattatgtatccatataatttacaatgaaaaattaaaaaaacaaaaaaatgacccaacctatgttttcacgtatattttagacatggtttatatctgcaaaaaaccttaactcaacacacatttatcattctattacctgaattattcaaacaagttagaaaattggttacttaaatatgatttatcaatatttttcatttcttgaaattttcttaatgatacacaatatgaaagcaaaagaaaaccaagtttttctactgttcttgtttttggttcagttgtacttcttactgggagaagaagatacagtgttttttttttaattaaacatattggaaatccggattctaatcaaatacaatattggctccattgcattgagaaaaaaaaagaataccttagtatttttttatagagaaattcacgtttcatttattcacttaaaataatgtattgatacttattctatgccatgttgggagtcaagaacagtgagagcaagaaaataatccactatatccacaaagtactaacaggttaaaagggaagatagcatatgaacagatgaataaagtacagtggatgtgtagtgttattggcatatggctagaatactgtgaaacatcaagaaggtaaataacactgcctgatgaatggtgttgtgcttatgtttatgcctctttatctcaaccaaagagcaaaaaacttaaaagatttgcaaataatgattgcagatttgttaattatgagttttattttaaacgtgttttaaaacaaagagaaaaacttcaaatcttttcacctcagtagactaacttaacctgtggggagtctaactgtttgggttacatggtattttagaacaccacaatacccctaggatttattgtatcaaccacaaaagacaactaaatgagacattgtaaaatccatagtattttcactgactcatttttagccagcttcctctagctttcttcaagctaacaaaggaagaaacttaagacactaataatgatgggccttacttacttagattagaattccggtctaatcttttaagcgcttatagcaagttgagaactgaacaactgtatttccacctaaacctcttcttcgtataatattggactatctcacaccatattttgtatatggtgttattagtttctatgcatcataatcaagactttattaaaaaatagattatagcactaaagttatatgcaggtatatactttaaaaagtcttaacatatttttaataaaatttggatctttacaacaatattttgctgtgagttaaacaaggcaatgcaaattttgtggatgccacttttatgtgtggggaactaagagacaaagaagtaaagtaacttgctcaacgttacaaatactggatacatagcttaacagtacatggcccatttttggaggattttgttttttcaaattagacatccttggaatatttgtcaagatgtttcatatcctgactaatatatgatacatgtgactaagccatatcctggaatcaaaccactgctattctatttctagtgaggaaattgtttttcccttattttcttaatatgataatttacattacttaatttttaaatattaggctaaccttactatttctatagaaaacccaatttaataatgatatattttatatctgtcagtggactatattagctaatatgtgtatttagtattttgcatatcttacattacagtcatgagagtgattcacctgtaatttttctttcagtggcctcatcaggttttggtttttgttttataaagattatgcattggaaaagtgttatttctgtattttctaaaagttatgaaatttttaaaaatatatgtaaaatttatttcttaaattctacatacctaaagtttccttttggaaaggttttttatttatgaactcaagtactttaacagatatgggactattcagatttctatttcttatgttaattgtaataagctcatttattttaggaaattgttcacttcatctaagttgacaaatttgttgtcataaaatgcctcatattattacattatactaaaatgctgagactactgaaaaggtagtcttgaggcagcagctgagatgaagagaaattaatagttcagtctcagtgctctgatatatagatattacattctgtgtagacatctagtacccagtttgatacttgctcattacaactttataatgtgtttaatgtctactaagtcaaggacaatttctttttcctttttcagaatgcccttgatcattcttgtacatatttatttatttatttatttttgagatggagtctcactctgtcgcccaggctggagtgcagtggcactatctcggcttactacaaagtccacctcctgggttcacaccattcacctgcctcagcctcctgagtagctggcactacagatgtctgccaccacagctggctaatttttttgtatttatagtagagatggggtttcaccatgttagccaagatggtctccacctcctgacctcgtgatctgcctgcctcggcctcccaaagtgtatttatttatttatttttgtatttttagtagagacagggtttcaccatgttggtcaggctgatctcgaactcctgacctcaggtggtccgcccgcctcagcctcccgaaggctgggattacaggcgtgagccactgtgactggtgacatttatatttacttgtgaattttagaatttgattattaagttatagaaaatattattaatattttgtaggtattagattgcactttcagaataatttagaaagactgacatttcaaagaaaattcaacattccttcacatgaaaacagattactaattgatttatccagatgttctcatatgctgaaaaatagtacttatattggtgtttatatccagccacttccttactgattttaatgattcatcattggagttaattaggagaaaatcatattgcttgaagaaattagccataaacactttataatgtgtttaatgtctactaagtcaaggacttagtagtcctctaatatataatatataattaaaataactatatataataattttatatattttatatataaagttattataatatataattgaaataatatataattaaatatatataatatacaattaaaatatataattaaaataactagaatggggagaaaccaaaatgaatacaaacagtaacagtgaatgaacaataacagtaatattgataaaactgcttcactaaagtgagtgccgaagaaaaactaatttgtgtaactgtctctggaaatcagtattttggctacatattttaaggctactgacaaaaataactacatagaaatattgtactctattaatgtatgtgtttgtcacaagaatataagttaataattctgaaactgctctacatgtattgtaggactgaataaatattttaagtacatattttatttatttgaataaatatgtatgaatgagagtcaattttctttttttatttctttttcttggtaagagacaaggtcttgctctgttgcccaggctggagtacaatggagtgatcagagcccactgcaaccacaaactcctgagttcaagcaatcctcctgcctcagcctctcacagtactgggattacaggcacaagccgtagtgcccagctaagagtcaatcttcttactttcaaaaaagagatttagttaccaataagaaagtggaaaggagagatttaatcctttagtttaaaattagaattagaggtttcatacgaactaacgattttaatgatagaaagatgtgttcatatatgtttcccagctctctgctgagagggctagaagcaatggcatcacagtagcaatgagcttagttcctaggtattgatttctgtatgcttctttaataaagtgaaccagaactccttggaaaatgactgatttcagggatgggcagggaaagtgtgagatgtacctggaaattattttggtgccagaaagagaggagatgctcaaaactgattaaaatatgttgaaagaattcaggagacaataggaaaaatctcccaggtgacacatatgggacaacttgagcacaatttaaaaaatgagggcaacggattaaacccatagactaagataaacatctatgtcttcctaataataaataaatgaaggagagacagaagttcatagtaatagctgaattagaataaataaaatggaaataatggaaatatgaatacaaacaattttccatagtagtactccttacaagcaagaatcatcaatgaatgttaaaattaaagagcaaacttatgatgagaaagaagatatatgcataattttaagatatcttctacatatacttaattccattggtaaaatagtaattttacacctaagaaatatggcacatatcacattacttacattaagcaagtaaccaaagctaaagtcaacaaggaaaagaaacatagacataaggtgcctctgatatgggaagcacacagtatcacttctgttgtatcattgccaaatattaataacctgaacaaaatcatgagagaacattatataaatgaaaattgagagatatttgacataaaaactgtcttgtactcttcaaacacattaaggtcataaaaaacaataaaaacagaaactgttccagatccaaagagactaattgtacatgacaattaaatgaattatgtggatctggatcggatcctggatcagacaaagagcattggtggatatatgctgcaatttaaatgcggtctctatttaattagtaaattgtatcgttaattttctggatttgataattatattatgatttaataaatgttaacacttgggaagatgtttgaaggacacagatactttgcacctttttgtaaaatttgtgtaaatctgaaaccattttcatataaaatatttaaaaaggaaatacatggttttggtattatactatagttatgtaagatataatcattggaggaaactcagtgaagggcagatagatagaaccatcttgaactatgttttacaatttaatgtgactctagaattattttaaaataaatagtttttagaaactctacaatgttctcatgactgtaatcccagcactttgagaggcaaagacaggcggatcacttgaggggaggagtttgagattagcctggccaacatggtgaaaacccgtctctactaaaaataccaaaaaaaaggccgggcgcggtggctcaagtctgtaatcccagcactttgggaggccgaggcgagcggatcatgaggtcaggagatcaagaccattctggctaacacagtgaaaccccatctccactaaaaatacaaaaaattagccaggtgtggtggcggcacctgtagtcccagctactcgggggggctgaggcaggagaatggcgttgagcccaagaggtggagcttgcagtgagccgagatcacgccactgcagtccagcctgggcgacagagagagacttcatcttattaaaaaaaaaaaaaattgtatatatataccaaaaaaaaaaaaaaaaattagctggccatggtggtgggtgcctgcaatcctagctacttgggagactgaggctggagaattgcttgaactgggaaggcaaccgttgcagtgagttaagatcgcgccactacactccagcctgggtgacagagcgagactctatcaaaataaaaccaaaaacaaaccaacaaaaactataaaatatgttaaaagctgactaagaaaaagacatacaacctccagaaaaacaatgtgtagattgatagctaagttctcaacagaaaatatgaagccagaagatgatgggtggatatcttcaaagagttgaaagaaaataataacaacattgcattctattttctttgaaattatatttcaattgtaaaagtaaaatagatatattcagacaaaaactaagagatttttgttaactatctgttgtaaatgatacattaagaaaaatatctacaataaagttcagagatacaaaaatttgtggaattgaaatgtaaaaaccagtggaattaaaattagaaagtgtaaatgaatcataactataaaatgcaaattctttttatacataataaaatgtatggcaatcatagaatacacaggaaggtaaatagaaatatgttctaaggacactgaattgtctgggaatttagtaaagtgctgatcattatttcagtaattatgctgtaatgaagtagatagacattaaaagtctcaagttttagtttaatggaatcattgtgtgtcccctggtagaaatatatatttttttaaagtacagtctctaaagcggcagagcctaaagtcacagaaacagaagcaaaaatgtttttaacggatcaccagggataaaaatgaaaggatctatttatttacacatcttcatgagattcataaatatgaaagaatagcaccataaattgaactctgatttagtgcatacagtagtacatcctgcggacattgttcaagccctgcaaagtgttaccacctacttggccctgtatctgggtcttcagaaacaatttcacttttccattcagacagttgcttctagttcatggggaacatagtgaaatcaatgaaaaccatgagcataaatctatggccacacttcatttgctgtaaagtgaggtccctggtcgtaagtgatgcttctgggaaaaatgataagatattctgtatgtccaaggatgtcataaataccgaaaaggcaaatctacatccagaatatatgtctagtacagtaaaatcagagagctgccacttccataatagaagtagtccaacttaatccaccaatgggtagatggctaataaccctggggaatagtgcagtttgggggatgcagtgttggtctttgctcttggaagactggacacacaaaaatagctgcaactagatgggtgttgacaagtggaagtcctcattcctgagaatatacataatctcatccctgctaatatggccactttgtccatgagataattggagaacaatagcagtggctgaggaaggagactgatttatttttccaggataaatcatcatgaatattaaaattctcctgtaccgagatccatctgtcaaaactctatacaaattatttggtttcttgggagtacctttgttcttctaatgcacaccctggctaaatttcttgattttccttaaagtttccttccttagaaactgatatctccttgcagttaccttactgtctcccttttctgtgaggtcactgttgaaatgtggattgttgtaaagccagggacacattcgtttcttagtagattataattagatctgcagatgaaggccatgggtttgagggtaaaatcactgtctccctgggaatttaattaccaaacacatgataagttctactttgcctgccttacagtagttttaagtactatttttcatcgtcagtatctaactaggaagcgtcctctttgatcagatgattaccttttttaagagaagaaatgcttgcaaaatactacattgctagttgaatattcctaacgtttttgtcccataggaaagaatgaattaaacaggccaaacagatcaactttaaattgaaaaaaaaaacacaaaaacaaacaaacaaaaaaaaaccttattgttgccaggaaagtagatgcataaatgccactctggtatcctggccatcttaaagggcaattcttcttgatatggaggtagtaagtataacatattcaaattatctaaacgataggaatcataatattttatgctttttctagcagaattattggtaaaacaagaatacttctaaacataccttcattccacgtgttagaaagcaatattgggggccaggcacggtggctcacacctgtaatcccagcactttggaaggctgaggcgggtggatcacctgaggtcaggaattgaagaccagcctggccaacgttgtgaaaccccatctctactaaaaatacaaaaaaaattacccgggtgtggtggcaggcacctgtaatcccagctactagggagattgaggcaggagaattgcttgagcgaaagaggcggaggttgcaacgagctaagatggtcccactgcactctagccttggcaacagagcgagactccatctcaaaaaaaaaaaaaaaaaaaaaaaaaaagaaagaaaaaaagcagtatggggatagttctcccacatgtcctcctctaagctcactcttaaattaaggtccattcacttcttccctcattcaaggaattccccacgagatctatccacaagtatcaattttcttaatattttttgattaagttgttggagaagccatgctattgcatttcaaatgaagcttcctttacactttgatgttcaaaatcattgtgtacaaaaactaaaacctattagacaatatttattggtactccctatccttctttactccacaaaaggtatgccagggatttaataagtaattggtataggatacattgagcttagagagctgatgtgcagttgaaattaagaaagttttatactatgaatttgttcatatgtgtttacacttaagttcacgtagagcaacaatttcaagagaggtaaatcaatagcaaagcagttaacatcaggttccttaggattttgaaacaaagattttagccatcagaggccagagtagataaatttagcaagatcacattagtataattattataaaagaaaattttactttttccatatggttaagattattggaaggagttaataaaatacatagcatgtttgtaattaagacacaaactctaattaacttagatcctgaatggcttttgctaagtctgtctccacaggctctcaaagaaacctgataactctggagttaaattccctaataaattataaaagtaattaaggacaagaaaatacagaatatttataagtgaccaaatctgcgcagctggaagagctaacaccaggtctcataaaacatcatgtgtatccggcagggttagagttgtcaactttatatggtaaaattgagtggagacgagcagctttcataggaaaatagcaaccatggtaggcatatcttacttattttggaaaacaagggaaaattggtatgtttcctgaaatatttattgatgattgtgtttcaagcatgatagaagaagacagttatgacagaaagactaaggacatatggtattttacttaaaggagctcagaatctgtacaggtaacttcattaataagtactgttataaaaggatacacagagaattatttaagcccagagaaataggatgttaccccgcccgaaggaaggttatcagagaacgcttcctggaagaaatgacacgtgaacttattcttgaaatatgagtagaaggtcttaaagtgaaaaagcagaagacaggaagacagtatctcaagcaggtttttcagagtaagcacagatagaatggagtaaaatggcttggggcgtgcagtttttcagtacaccgattaaaataatgaagccaagaagtgccatgaagaaaggccagagatgtgggcaggggtcattttatagaagacattttattctaaacaaagaaacttgaagccttttaacaaatgagctcctcgtcagagttccttgtttgaatgctcactttgccaatagatcaggacagagggaagaaaagttggttagggtgataagtaagagtctgatatagtcagggagaatacagagagaaggcatgtagattcaataaatatttagaaattagcatcattagacattgatttggatgtgggaaatgagagggtaaaaataagaagtcaaggatattttccaggaggagaaacagacatttagaggtagaagaaagggtttctcactttacccactagacttaaagaagcattactgagctaagtttgcaagctaccttgggaagtctagccctgttctgagaaagtacaagaaataattctggcttttgaagactagagtatatagctagaagaaggttttcttgaaactaggctgtttggggccaagtaaactaatttttttaaactgaaaataagtgattctggaagttgacattctatcttgtttttgacactcatatattgagacaagataaaatttcagtagaaaaggacattgaccagtttgtaaaagtgatgtgaagtagtaggacactccatccaactttaccaagtgttcctttgccctggtatgatccacggtggtatgtaaagttatatatcccattggtccataatgaaaaaaattcacgtgaataggaataagctaccaaaatatgagatctttgagggaatgggatatattgtagacatttattgacagcgctagcatagcattggatacacagtaggagcacaagtaatgagggctagatttaattgaatgacattgaaataaagctgttagttactaactgcagattgagctctgcaaaatgtgttacaaagcatttcagtacagcatcttggtggttgaaattgttcgtaactagattaagcagacaatttttatcaaatagtaacatgtcataaagataggaggagaaactaataaaaaacattttttatgtactagcctagaaggaccataggccctaattatcaaggaaatagctccttcaatcatcattgtctcatatgtcctagggaataatgctacaaaattctctcctgctgtgccataattggctttaccattaatgcagtccctggctcctttttctcttgtggtgtttatatgtttctccccatcatgtcagatattattttaccgcaaaacccttttttaaattatgcagaatgcaaaagtatctcaagtagattttctacacgaaagaaaattaacatctattttacatatgatatgtgccacagattgtaccagatattatacataaatttaattaaaattaacaatattttctactctggaggctgaggcaggaggatcacttgagctcaggagttcgaggttgtagtaagctttcatcatgccactgcactctggcctgggcaacaaagttagacctagtctctaaaaaaaaataaaaattcacaatattttatagaataagtattattattattcattttatatatgtgaaaaccaatgcttggagaggttaagtagcttctcaagttcccacagatacagagatgcagataaaatatcaatgtaggtcttcaggcctcaaaagccatggctttccactgaaccatgctgtctatgaagtacatattggaggaaccttctcattttccatgtattaggctccaaataaataaatcaccctagtacaatttttacgttttcaaattcaatttcataaaatggtgtttgtcacctattcaggacttcactgtttgttttactttctcgtatccctaagtagtattgacatccctgtccactatcctcctagtggacaccaagtgcatatccttctggcctactgcactcctaaaatgtcctcatgatccttggatctcccttttctgtatcctgccctcacctgtagtaactcctcacaatcagccagtcagtctaaactgagtaataagatctttctccctgcaccttagcctcatctcttcgtgggttacctctgcccctttcctacacagcagccactctgaaatgcgtgtagttccgcaaatatgccagactattttatcccattttgactttgttcatgttatcatctttgctaggagtatttcatttcttatggagaacacctgtccatcattcaacgttcatttcaagtgaaaagttctttaaaacataccatgacctttacagaggacaaaacactgcagtccagcctctgttcataggttctataaaggcgttgttaaatatatgtgctagaaaaatcttgatatgataaacataagatacagataagaacttctactttttcaagacaatggttctgctttcaaccgactgcattcttcacagcactgccaattaagtgaagaagctctgtagttgtttgtgctttctctaccctataacattatttgatggttagtgtttatgctgtcagatctaactctgctgacctgatttcaaatacaatagagaaaattaatcttaggatttttcttttgtgtttgcctatcttcccgcacttatttctcatttgctttcattttaatgaaagcaccatcatgtaaagaaaaatatgttaaaaacacacttcactaatttcttcttttttaagaaaaaataaaaatactgaaagtgcccttggtatccatgaagccatgtgtctgaaggctcaagatgcaatgttagcagtgacagtgagatttatccagggctatcgcttgctttgaagattaactacccagctgatacactcagcatcattttagatgtaactgggggtcttctacggttttaaattttgttaaaaattctagccaagggtgataaactgattccaatttagcttcttctttaaacagaatctaagcccagaaatgaagccagccacacctttgaagtgttgttgaacatggcaactgagtggggggcgggaagaagcagaggaagagaggtgagaatcgaactgagtttaaaaagaaccacaggctttgggttgcatttgctcaacctctgggttgttcaggtaaggaaaaatatcattaaaaatagtgggggaccaacaaaacagtttaaacaacatgtatcctgggattttttattttcaggctagacgctttagatttagtttaggttctacgttaaaaacagaaagatccgaaaagtatttccacctctgacatataaggcattggattttttttaaaaaaagattttactgccatctacttagtttacttctggtttatcttttgaagtagattcccagcagctagagctatctaaaatattaagtggttttatggcattgtccaagacttctaatacattctccagaaacactttcccatcagtgtaaaatttctaatgttggacattatttcaggggattgagacttggcatgttcttgattacttttaaaatgtagagtcacatgtctcttaacaacacatatacattctgaaaagtgtgttattaggtaaatttatcattgtggggacatcataggctacatgttggggacatgatataaggacactaaggctatatggtatagcctatttgctccaaggctgcaaacctgtatagcatgttattatactgaatattgcaggcaattgtaacacaacagtaagtatgtatgtatctaaacatatctaaatatagaacaggtacggtaaaaaaaaaaatagagtattgtaattttatgataccaccatcatacatatggtccctcactgactgaaacatagttaggtggcacatgactgtgtgtatctctgagaggcataatggtaacctttcaacactttatcagagattggaaagcaatgacttgacaaaagattcagaaggaccaggatgggggctgataagttctgatctatgaggtgagggaaagaagactgataagctaaaggtgctatagtgccacaggagttttaccacaggtcgaacaggagaaatcaggaacacctcagatgtgtctacatgtatgaattcctttgaatgtatggtgataaatactaatagggataaaatggtaaaatgaaatagtagcccaaacaaattatatttgactcattctgtaaaactctttgttttgtaagtttggggataggagctataacaagtgaccccttaggctctcagttttcccaatctataaaactggagcattggactgttttactagatcatgtttaatctactttttaagttatgtgtgtgtatatatatatttatatatacctatatataaaatattaaatatatatagctatatataatatattgttgatatacattgattatctatttatctatccctatttaccactttacatctgtttagtaagctttaaacaaaaagactattgaatcaggaatctagagtactttttttccactctcagctctaatgataacttgctgaatgacaatacggaaatcatttaccagctctttcccttagttttctcaaaaaactagcaaaagaaagaattagactcaaggaccctaaaactctctttcagctctaatctatcatgggcctatgctttatgtaaacagttaaattttccacatatcaactgcaagagaagcagtagtatttccctatgtcctacagatttaaaaatgatccaatgtggtgtcttggcagttaggtccctggatttatctgacactctaactgtgcctctttcgtccttcccatcgacctacagaaatcattttacttccttttcttagggccaactccaactgcatttctatctactgtaaaggaatttctatcctatctctcattccaaagtacctacatacaatgctcatagacttattttttcttttgtagtcatgtccttgaaacataatttttactatacatttccatatgtaattaaaattctctttctgccctcttttgttactgaaggagaaattaataacaattttcttcttcaacattgaactagtcagtaaagaacactttctccaaaattagtgccaaccctttcagccaatacagttagtgggtatagtaaataggaaacacctggctactccattgacttatatctcaagtggataattcctttgcccaggaaatttcagagaggtgactcccatcccagtgtatcttgtgtcttatactgcaaagactcccactagggagcaaatgtttataaaacaataccatttttggtacataaaaaaataccattacttattattgtgttttatctttctgtactctaaattaaaaacatttctgtcaagaggagtatgtttgttttctatgttgtattaaaaaaaaagccacaatctcagtggcttacaacttcagtttctgtagttcagaagtccaggtgcagtttacctcagttctctgctccagggtcttgccatattgcaagctaggtgttttctagggttgccgtttcatcagggcttaactgtgaagagatctgtttccaacctcactttagttgttggagaatttacctccttgtggttgtaggacagagggtccttttttaagattttttttttttttcctggctgttggccagactgctctaagctcctagaggccatctgcagttccttgtcacatggctcttccacagacccgcccacaacatgacaggttacttctccaaactcagtaatagagagagtcgcttacttcagtggaagcctggctccactttggagaactttcagctgattagttcacgcctacctaaggtaatctcccttttgattaattcaaaatcaagtgatttagagccttaactataactgcaaaatcctttaacctttgtcatattctattctattgccagtcaagcagaggaaagtagataaagacgtgaacaccaggaagtggaaattagggttcactaaggaacacagggcttatttggcatgagaactattttcatttcatttgtatgtcagaatagtgccctttattggtccattaacagaagttctgttgtctcatagaggaaaataactgtaattgtcttaacttgtaaaagattagagcttgtgtgtgaaacttaatagagcaaagtgatctttgctttctctcccaacgcataaggctttagaaataactgaagtacataattgaattaactgatgtccattttaaatagcatagctctttttgtctatattctgaaagtttcattctgcataaaattttctttcaaggtgttttttataagtgtttcatgtaattcccactggtagtttgagtagttctccatgacttacaggtttaaatgtgcatgtgtatccttatatacatatgtgtgagtgtgtgtgtgtgtgtgtaatcagtgcatgtgtgtaattttctgggtgaatgatgagataccttcctaagtgttctgggaaaagagttaagcactttgtgtattagcacatcagagctatacaataatcattgcagctaagtaatgctataactaatttttaagacagaagaactcaagcttagacgagttatgtaacttgcttatgatcatactgaaccaagatgtgtgtagaatctggattcaagttcagaactacctgatgctagctagcactttcaattctttatgaatagactatagtaactcagaagcatatatcattctctccattttatgaagaaggagatccatctacttgtccaaggttaaaatgtctttcccacctgtttgtggagtactttgaggcaaggactctgtcttggcacctttatattcttgtcctagcacataatagtcaatgtatagcctgaagttgacctaggttaagacttcaatccagctctcctgctttcaagatctttctattttcccctcccaatcaatatctttccaaacctagcccttaatgtaataaaatgttctcttgaataacctgtaatttgtccagtggatcaggattcaaatctttttaatatacttgctctgcaagtatgttaaagggattaatgggtttcatggagagagttttctgggtgaataaactattttgtgagcaatttaggaagcacattagttccttgggcctgtgtgaatagtacttcagctgagcaaatggtgcccctgtggcctccaatttaattaacttcccaaatatggctgactcatctctctggcaagatcattgataaaatgatttgaaccatgatgaaggagaattgataaaatgcaaactgatcaaaatgtaagaaaacattctgaactaaaggaagtgaccttccatgaagttcaagttctctaagaaaattcagtgattaatctaagattgcttcacacatgattaagaacaaggcacagaactgtcacctagggcatatgatatgattaccttgaaaaagacataaagaatgaccattttagttactaagattttaaaaaattattatttttattattttctgttagctggaatagctattcatactcaagcagagaattaaggtattcaatttactaataatcagaagcaatatcctaacgtcagatttacaaagataaacatttttctattaatttcatattctagtagccagaaccagctagatttctttttttaattttcaacaaattaaaaacatccttttactggtaaaggtcctgaaagcagtggatactcatcttgatagaattatggcatatatcccaactgctgctcacaccttcccccagaaacttgaacgctggcattctctccaatttgcactaaaattaaaattacttagagctaccttgcacatctcaactgaaatttatttttattttcattgtcaaatcttacctaaattcaccaatttttatatatatatatatatatatatatatgaagccctgaagcatataagcttccttcaaattcttatttagctacaaatgtgactaattttaccccttcctatttttattggttacttaaatagaatagtgcagtatcattgctagtgaatcaacattctgtgagaatgagctgagtcagcataatcatgtgctacgctactttattgatgagtaacccgaggtaaagagaagcagtgactttcccagtgtcaaacacatcagccaaaggacaccttgaaaaccctgagtccgtgaattgccatccagttgcttaatgtgctgaatcaaactgtttctctttaaaatctgaaattagttttcctcatatatctatatgtaacagtagctgagttagaacctgctgtgttctcatgggatagatttttaacatgatgatgatgacgtcgccagacatactggtgaaatcttctcagaagaaacacttcatatgaagtataaaaacttacactctacactgtttttctaacttttagaaggcatgagtttccacattaggggctaccaaatggtgtgagagaaggaagaggaaggaaaaaaaggagatgtgagtaagggatgagaggttactatcctgtccttatacctttttaatgagagatgctcttaaagcaggtaagggagtttcccatgggaactcttttgataaagagctcctatgccaagaaaatgtttgcaaactacaaatgcatactgagctacaatatcttttaccttttatgctaatgtcttgaaacttgtatatcgtttttatagatctagagactatggggatcaaaggagaattcagtctgcagattataataaaaaagattttgtaacagagggtttcttatgaaaacacacaaagctgcttttaaatgtgtactaacagatacattgatgacctacacaaattttaaatttgagcagccaatgaaaaagaatcccctaaatctctctacacattagtatccacccaagtgtgtttcaagaaatcaatgttatttaatattttattttattttttgaaatcattgtgattaaaagaaaaccgtagttatcaccctaaattaaagtcatcatgctaaaatctgagccttagaagattgtagtcatccattcaatcaattcatcaatatcaaaggaatacttactgagcacttagtgtggaataaggtgccattctatactctagggaatggacatgaacaaatttagaactcctaacttcatagactttagattgtctggagacagcaggcagaaaattgggaagtgggtaaggcagacactaaacaagctgtctttataataactaggatggtcaatagtagcttcataatcaaggagcatatatcaagcaaccttcaacaaccttataacaacacaagccttatgaagatgcacatcattagcaataaagggtagcacctcaaagttgatgagacttgtcacgctggaaagctcttcatccacagtaacctgacctttacttgcaattacattctctatactttttattccctctgcctaagccactagtttaattccttatacgcagtatatggtcaatgaacttttgttaaatacatgaataaattaattaatgtaaaaatgtgacaaagcttatgtccagtctttcctaataagctaataattttcccacggttaattaattagaataatatgttgtctttttcgtatatgctatcaggaagcttacactggcattttgattcaacagctgcaatttgcctaataagacttacaggctttttatttttctcactccacttacttcttgacattttttcttcaatcttatattatccgattttggcctcagtctttcttcatgttttaagtaagtggaattaaataattgttgaaaggagacaagttcaaatcaacaatattatttaggaatcacagaaagtagaaaacaaaaactggtacatagtgttttatccccaagcatgtctttctttttctttgtcagaaaataagttataagttttaggtttgccaccaagggagggagaaaacatataaattatatacttatacaaaagctttattttcctaattataagaacaaaagaaaacagcattatagtggaaacataagaaaaagaaaggaaattaatatctactattggtaatacttttggtgtatttctttctgttatatggaagaaggaagagatacatgtattgaaacgtatattgttaataacagtttgtaactagataacttttcaccgaagtctgtaaaactttgtaaaacattgctcttagtggttgcacctcatcctagtttactgaatactctccctattattgtctatttatgttgttttgatcatcaaaacatgattaagcctatgtacaatgatatgcctgaattttgcctgaatcttgttttatttcctttggacttcttttggaattacacggtcaaagtatatggggttttatgaagacaatttccagatgaaatatcttttcacatatctcttactgtcttatcactctcctatcctcagaatggatttccatttatcaaggtctaacatctactgccatgagacattcttgaaataatgaagagaaacatggtgatacccttattgttttttggaatactatgctttaggaagttcctagattgtgccagcatttgttcttacaacaacagcatattgataaatcatatttagcttaagatcaatatttcccaacaaatgcagagtcctttttcgtatgcattgccctgtgttttattgagtaccttctttcattagggagctggagaatttaagagtcattcaggaatgaatgcttttaaaattttcagttttgtatggtagcagcagttttgtgcttatttcacaccctacttcagaatgtcctaggttgttgtcaactcattcaatcacttattcttcttttggtcatttaacaaatacttatttaacacctaacacgtaccagtatcttttctatgtactggactacagttgcgaaaaataaataaacaaacaattatgtgaaagagtttgaaagttttgtataaaacttactcaaatagcaattgtaaaataattatagaaaataacaatgcactttggagaatattaaaaaaaaagaatagaataataggaacaataataaaattagtgtgattaaatattacatctccttgtcaataacaaagccagaaacaggtctaatttgaaacaaaaagattatgaagagtctataaagactagcgtattagtccattctcatgctattaataaagacatacccgagaccgggtaatttgtaaaggaaaagaggtttaatggtgtatttgtccatttcacgctgctgataaagacatacctgagactgggcaatttacaaaagaaagatgtttaatggacttatagtttttcgtggctggggaggcctcataagcatggtggaaggcaaggagaaacaagtaacctcttaacttggatggcagcaggcagagaaagagcttgtgcagggaaactcctgtttttaaaaccatcaggtctcatgaggcacattcactatcacgaaaatagcacaagaaagacccacccccataattcagtcacctcccattgggtttctcccatgactcaaaacacatgggaattgtgaaagttacaattcaagatgagatttgagtgggtacacagccaaaccatatcattccaccccggcccctcccaaatatcatgtcctcacatttcaaaatcaattgtggcttcgcaacagtctcccaaagtcttaattcattttagcattaactcaaaagtccacagtccaacatcttatctgagacaaggctagtcccttccgcctatgagcatgtaaaatcaaaagcaagttagttacttcctagacacaatggcggtacaggcattgggtatatacagccattccaaatggtagaaattggccaaaacaaaggggcaaaaagctccatgcaagtcgaaaatacagcaaggcagtcaaatcttaaaactccaaaatgatctcctttgactccatgccttgcatcttggtcacactgatgcaggagttgggttcccatggtcttgagcagctctggccctgtggctttgctggttactgcctccctcctggctactttcatgggatgctgttgggtgtctgcagcttttccaggcacatggtgcaagctacggtggatctaccattctggggtctggaggatggtggcccttttctcgcagctccactaggcagtgcccagtatggattttgtgtgggggctctgacttcacatttcccttcctaactgccctagtagaggttctccatgagggctccacccctgcagcaaacttcctcctgagaatccaggtgtttccatacatcctctgaaatctaggtggagcttcccacacttccattcttgacttctgtgcacccgcaggctcagcatcatatggaagctgccaaggtttggggcttgtatcgtctgaagcaacgtcctgagctgtacccaaagctggagtggctgggacacagggcaccaagtccctaggctgcacacaacagcagggccctggacccagtccatgaaactactttttccttctaggcctcctggcttgtaacggaaggggctgccatggagacattttcctcattttcttggtgattaacatttgactccttgttacttatgcaaatttccgcagcccgcttgaatttctcctcagaaaatggtttttcttttttattgcatcgttcaggttgcacattttctgaacttttatgctctgctccccttttaaacataagtttcaattccaaaccatatctttgtgaatgaataaaactgaatgcttttaagagcatgtaggtcacctcttgaatgctttgctgctgagaaatttcttccaccagatatcctaaataatctctctcaagttcaaagttccatagatctcttgtgccagggcaaaatgctgccagtctctttgctaaagtatagcaagaatcacctttgatccagttccctataagtttctcatcaccatctgagaccacctcagcctggactttattgtcagcattttggtaactatcactatcagcattttggtcaaaaccattcaacaagtctctaggaagttacaaacttttccacatattcctgtcttcctcagcactctccaaacagttccaacctctgcctcttactcagttccaaagttgcttccacattttcaggtatccttacagtagcaccccactcctggtaccaatttactatattagtttgttctcacgctgctaataaacacgtacctgcgacttggtaatctataaaggaaaagaggtttaatggacccacagttccacatggctggggaggtctcacaatcatgggtgacggtggaggagcaaaggcatgtcttatgtggtggcaggcaagagattgtctgcaggggaactgccctttataaaaccatcagatgtcatgagatttattcactatcatgagaaaagcacaggaaagacccatccccatgattcatgtatctcctactgggtccctcccatgacatgtgaggattgtgggagctaaaattcaagatgagatttgggcggggacacagccaaaccatatcatctagcttctgggactattttagttggactaaatgaatgggctaaatatagtccattcaggactaaaattgtgagaataatggcatagtcagtgacaacaatattatatctcagatatctcactcatacttggtaaacagacactataatgtttaaaagacccataattagtaattgctgcagctgtctaaggtaaatgtctcaaaccccatactagagagggcagttcctgaagtacctaaagggtcttgatatactagaactgcatctctaagaacacacccattgcagatattaaatagtattacatggatgaaatacagctttctgaattttataaaagcttatgaatgggctgaaataaataattcctaattccacaaaatagcatatgtaaagcacttttctgagtgcctgaacatggaaggttatttcaatcactggataaataatttccaggttacaggtcctgcctgcagtcagtattgaggatgcaaagataaatgtcaggtacagcaaggaaggaatgaatacgtagagaagtaacaagactaacatctatgtgtgcctaggacaaattatttagaactgaaaggcagagaaatgtaaaggagattttcatatcccctaaggtttcaagtttctgtgcttaaggatatagcgagagagcactaccccacagaaatcaagaaacgataacaaaaacaatacatagtaccatctctgcagattactaggaagagacttcccaatttattcaatttgtacaattcctttacccacagaccttgttttcctaaaacagaagcacattacaaactaatcatttaaataagtcactctgatgtcttgctgacacaggagaggatttgtatacattttcaaactgttcttttttgtttctgatagggataacataatgtgccagcactgtgtcctgacaaagaaatctaaatccattcacaggcataaaaaatttgaatgccggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtagcgggcgcctgtagtcccagctactcgggaggctgaggcaggagaatggcgtgaaccccagggggcggagcctgcagtgagccgagattgcgccactgcactccagcctgggcgacagcgagactccgtctcaaaaaaaaaaaaaacaaaaaaaaaaaaaaaaaaaaaaaaaaatttgaatgccagatccagaagaggcgcgacagtgtttggtaaatctgtgaatagacaaagatttagattatacaatccactattcagaactagctacataagttgtggggaacagcacaaaatgaaaatgtggacacctttgttcaaaaatggttaagaatttcaagatgtcaataggagagcattaaaccaagtgcagagtcctaagcatggagccataagcttgggaagctgcactgccactctccttcccatccattagtggaaaaaccaagtctattttgtctaaacacacggggactgacacagaataggtgctcaacaaatatatgctaaataaataaatatgctgactataatttatactttacctatcacatccaacttactaatgaagtggggagggatgtttacatggtatcatctgaataatcaagcctgaatttcccattattctttatactgggggctttcaaattatcctagtaccagtgtattctgatcttacttttctctccttttcgatcagtattttgtagccaattcagaatataccacacaattatatgtgtatatatattatacttcatacatagtccatatgtttttataaaacagatgaactacaaaaaaatagaaacactaacaactttagaattaggacaacatagaagaaaatatgagataagaccagagaaaagggtaatatgcaggaatgcagtctgtaagatccaatatagtaaataaactaatacatataattggctctgagagtcccacaaagcaaaacaaagaaagctattattagctaaaaacttgttattgtttatagaaataaagttgtagtaaatgtattaaataaacagaacttgcaggtttacttataagcaatatgttgtttcgttttgttttttttttctgtgaggaaaatcatttcccttcccctgaatggaaattaggacatgtctcattaattttgaaacactactaggtgataaaaggtcctccagtcagtaatttaagtgtctaatctcataatttaaatgcctaaaggagttaatatgttaaactttcttaaacttatacctatgcccctcaccagtctgcacaaaccataggctaaccccttgcagtgagaaagaggtcacagttgccttctgctctctttcttcacctgaatgctgtttttttctcttctcaatcatgctagtaatggtcactgattcttccagactgtgttacccttagactcaggtatgagagctcttacccttgaccccatgctttggagaggcttctgttggctgtcttcttgtcctgctctgtcatatgggacagagaaatcatgcagatcaaggaaaaatacaccttttcagaactgtcttctaaccccactataattggaatacctaggaccctggcattctttgccaaagtgacgccagccctgattccatgttctatacagtgctcctctctggggtttgccctcccaaggatagggctgctccgttggtgtgaatacctttggcttgatgggtggccaagggccagctgttcctggcactatgtatgaaacttggacatcacgtggtgccgaaggaaactggagtaagaaaagaaggcagacagactacaagctcttccaagggtcaggaggccaacagtgagctctctatatgctgttaatttccagcattggactaaaaaggatctaaaaattttaaattcaactctagccttgcagatatttaggaaggcatatttgtcatgtaagagaatagaacattgttttttttaaagagagagagagtgtgtgcgttgtgtgtgtgtgtgtgtgtgtgtgtgtgtttaattcatagctaaatctttagacataggatgttgcttgggtcccccaaacagtaggagtgagtctggctccaaagtcagttgaaataggtgtaccagagaaaaggaaaaacaacaaagagtttcttacatgactaaaactgtaattttatattaagttctgtgcttctttctcatgggtgtttcaaaatgacagattttcttgtgggacaatttgtgagttctcagaacctttgcattactgggtaaaggacagatatgtgatggacagtatatgtatatttccattcaagaaaaagttgtgttactttgcccctctaggtgttcttggtcaatctctaatacagctccatactagctctctaagtggtctacatctggtccatagtaaactttcatatatattttgctctgacaacgtctagattaacatggccatctctctgctgtttcatgacagaagaattagcctttcagtctcttgtccttgagatttccttggctaggtaaaactccaatagacttttgcttccacatttccagagaaacgtttatttctcccagaggtctccttcaagttttccttttttgaatcgagatgaagggaaaagctcactaatggaatagggtttcttacaaccaactctctcaaaagaattatcctttaacatctaacttcccaacctgttcacatcctcaatgtgatgagggagttaagagttgtgaaacaggcttttcaaaaatttattttgtaagtcatcccttgtgattttgaacttcaatttaataggggatatatattgtattgggacttcacttgaaattgggaatgaaataattgcatttaagctttttttcttttaaaaatgcataagccttatttttcaggagaaacaaactgtttttttctggccctaatgtctaaaaatagaacatagttcttcatataaggaactgtacaatcaataaaaacgacagtgatattaataatagcagctaacatttaaccaaatacatcttgcaaaagtacaaatcagaagaaatatttagaagtccaaatgtataccctgttgtgtaaaaaaggggattatttcatgaaaggtggtggtacgggaagtcagtaaagccctggaagttcttcacaaattttgtgtataaatgtttatgtgtattttctgaggaaagggccttttgctttggataaaatggataaaatccccgaatagaaagatgtcaggatcagcattgcttttataaattatggagcctcaccataattcttagcagatgaaacagtcatcaataaaaatagtcaaaagatcaatagacgtcagaagtgaatggagctaaatttctgcctttttttgtaaagtgagtttgcacttttgacttacttgtgaaagttattacaactttgaatgctcagttgctaagcagaaaccctaaatcaatatttaccatgccctaggaatcacttctttctctctctctcagatattctagttgactttgataaataagtaggtttaagaactactcttttcgagtcctgtttctcaattgtatagagtaggtaaaagaaaaagcaacagaattattgaaacaccaagagagctttatgaaactatacagatcaatccctttcctctaccaacagataaaaaaggcactccaagaagatcagttaagggccaataataagaattcaaatcagagtgtatagggacatactgcactgagaatgggaaagaaaggatgtgtattcaagattttatttacagtgttattaatcttagaaattaaaatttcatgatctgtaacatcgcactatataaccctaataccagagataatacattcaaattagatagaatatttgaaaataaacatggacctcaaaatctcttatgtctgtgaatttaaagggacgttttcaaaagacattaaaaaatcagtgaaatcctgcacttttccattttgaaatgcccacttaaagatatgtataacatgataatgtttactctcatacattaactaaacaaatttgttattttgtacattcatgaggtatttcagaatttctgaacattttatatactttaaaacaattattctttttatgcattcagatactcccataaagacatcaaatagttttcccactaatgattatcaatatttctacttagagataataagtgtagtataattaacttgagtgtatttaaagtctaaaatagtacactcagaataatattgaaaattctcctcccttgactaaaataacatttttattcatccctcttatcttatttcaaattgaagcctttttctgttacaatagtattaattctatcagtcactagaagtctactcatggtctgcaaagtgtaaaaaactgtctttgtaaaagatacctcaggattttactccttatgtcatggacatctatgtgatatttcaaatcaagcggttcacaactacccataaaaatctgattcatacagagatatcgtcataaacaagtatatgtaagcctggcatttgccttcttgttgttttatcacactgaaaactacttaaaatggatgattggaggaattgcataaattctccttagaagagcgattcaattgccataaaaaatagagggctagccagatgaaaatgcattttaataggagaaaagttctaatagttcattagatgaatattaagcgcataaaaatatgtcattatgatataaattctgaactcccaccaaaatttttcattcttctatagtcagtcatgctcattctctttggacccagtgtttccttactagggatggaaattaggggtggagtgatggagtgggagggggtgaattgtatgatctaaggtgttatcctctcctctgattcctacacctcatgcatatttggaagccgcagaaacattgttgtggcccctgagttgttctacttgccctatgaaagtggtaggcttcacacagacaacaatttgcttgaatgctgaattccctagatgataaagccaaaatcacagaatggggatagaatgaaccaaaaacacttggttctctctagttaaatatttcatgcctgatctgttgtagcttattctatggaaattaaaaaaaatatttatttctatgttgagcttcttttatttctggagaaagcatttcaggtacttgttcctcgacttgtggtatttgaaatatgaattctgaattcgtggcttatcaataaaaacacattgactttcacggaggttgactggtgtattctagtacaggagtagaaacatttacttacattgtgttcacagctgataaactgcagttgctaacagtttgttaattaaatcttagttaagctttgtccttcctgcttgaaaacaggaactcttaacatctgaggctgcaatttgcatgcatcagtcaacacaaatgctgaacaaagtgcttgtttaggtaataagataaggaggtgccctctccacatttcagctctgaccgcctgagaagcaacatttcccaagattcccagctgctgcttgttcaggcagctctgtggtttgcgctgcatattaatttctgtccgacacgggaattcaatttgtactgtacatttcatttcttcacagatttagatttatttcatgttctctgcttttaattaactctctggcacagctgctggacaggatagaaaaactcattgctctccctgtgttatgagtacaccaccaatcatttgccatttagatggtggtgcaggagctatcagtttctatggcaaccagagccgtggtgattgattccttgccagtatggcatcaccacagggagtgcagcttgtgatttttgtatgctcgcaacatccatctaattaaaacaggattatggaatcatcccagtatatgttcagcaactacactgcattccatttatgtaaatgtcaacactattaaatacagtggtcagaagctgtttataaagaaatacttgccttagtctttggttgtgcattgggaagtgagggcttaaccacctggttttggccatttattctcttaaatggtagcctttaaccaggcacagtcattttgcatttgaaaatcttatgaagcaaagccaaacagttacatttcaactgatgcaatgcttgctagctctagcatgcaatactaagcctgacttggaaattggctaattaatttagtgtgtatgctaattatttattcatcaaaagctcttaattcacgtgattgatttctctttcattggcctcccttgagagcagaacatccttctgctctcatgattttcttctcacagagcattcctcaattcctttaacagttgcttgggatttggggaaagcttacctaccaggtgagataaaagatgcacttttcaccgttgtgcatggagactccagatgaaaaaggcagctcagggacttcatgaagggctaaatgagtaggcaagcccatcagagaattgtgagctgtatatgcaaaataaaaaagaaggacagagggtgacagatcagttagcaatgttgtcttatacatcagattttttgctggatgagactgacaaaatattctgttaacatgaaaaatgacagtctgcactcctaatggcttcatgtccctgtgcatttcattttctaatgtatttctgttatagaagctgccactgtgacatatataagtatgcactgtatagtatgtgtattcgctgtcaaaactctattcattttacagaatttttttcccttgccttcacatatgttatatgaagaaattgcacattcaaatgatactgtcagagatacttctggttaaattttaattattagtactatacttcccaaaagtttcatgacatttcaaagttctcatgaaatgacagtaaaattactcccaaagcaggaaattcataaaatgacaaaaatctataaaacattttgactagtgaaagaaaagggattctaatatcggctaggatgtgatgattggctgagacaaaactgatggaaagaagagtgcttcattgaatgtagcttttaaaatacatagtttttcggttgtggtatcaccaagagcatgtaactaaatagtgggtgtaattcgcggtattttctttgtctggggcacacagtttatattgcatgtatgtatctactctagacattagcgtgtcacacttagagttacaatatatgccattctgccgggcgtggtggctcacgcctgtaatcccagcactttgggacgctgaggctggtggaccacgaggtcaagaaattgagaacatcctggccaacatggtgaaacctcgtctctactaaaaatacaaaaattagatgggcatggtggcataggcctgtagtcccagctactcaggaggctgaggcaggagaatcacttgaacccgggaggcgcaagttgcagcgagccgagatcacgccattgcactccagcctgggcaacagagtaagactccatctcaaaaaaaaaaattatgccattcattgctagttcattaagcagtgaaggtgatgagcatgcattttatctacaatggtaacatcattcatccctcatgtctactgtcctttcagatatttatgctaccaccagtactccctctgagcccctcaaaaatcattagctcacacaaataaatccaaaaatatttttgaatatttcttttttgaaagggacaaattgtatattacacaacgcaagatattttaggataattttgagggatttttccaagtaatgtgaccaagaaattaaactcattagctaattatttttgcttatttaacctaaaaaatccatgcttcccttaaattttccttttttgaaatgaagtagcacgttctgtactacaaaaataaaaagaatatttcagaaatttgtattgcttaatttgtaaagatgctagatatcttcagtgaatacttggctgacaaaaatatagggccgggagcagtggctcacccataatcccagcattctgggaggccaaggcaggcagatcacaaagccaggagttcgaaaccagcctggccagcatggtgaaaccctgtctctattaaaaatacaaaaattagcagggcatggtggcacatgcctgtaatctcagctactcgggaggctgaggcaggagaattgcttgaacctgggaggcagaggttatggtgagctgagattgcaccactgcataccagcctaagcgacagagcgagactctttatatatatatatatatatatatatatatatatatatatatatatacacacacacacacacacacataagctagaacctgtaaaatttttggcctactatctcttcctctgtacatacctcatgtcctcaaaaatcatattttattgcaatgttaaaattatcaatatctgcactgcatggaggcaaaaaatgatgttttcctgagtacttacaaagcttatctactgtatggttagaatatgttttgtgatatttttaaaaactatagaacatgataatgaaaatatatttcagggcctagaatggtcttgaaaatataaaatattgactttctgaaaaacatcacaaagattatttagatacctgtttattttacgcattttttatgattcatgacatctgtgatgacatcaaatagtttctaaaaatgaaaatatgtactactttcaaagaaaaatcttttttgggagtttaatttttacggtccttatcacaaaagtggagtaattaaaatattgagtcaaggacttggttatgctgcattccagatggctggagacatatttgatagtgcaggtgtcatgttaatatgacagcaaattagtggtgtatgtgtgtgtgtgtttaggttgatggaacctagggagtcattacctgactatccacatagaaggaacagctggccaaataaagatctataccttagaagtgcacagactttattcaagctttgatggtctgtaaatataagaggtgtgttcttccctcttttctttctaagtgtaacaattgattaaaaatgaaaatgcatgcttttcaattgaaatgaatgttatcaacacaaatttcactccagatacagttcaattgaatcaagccaaaataaatgttgccaaactaaattgtttcatgtgttttctggtctcctttcatatgtctacaaatggtggcattaagctgatggaccatggaaatatgagtctgagaacagccagtatcatctcttagaaatctggaaaaagtacaataagacatgcatagattaatgcttgagttataagagttaaacaagtaaatgataaataggtagatgtataaataataggttaaaagagagattagatagatgatagaagaccatcggtatataatataaagtgtatttttattacgacactactaaaaatgtttgactaccactaatataaatgaacaggaaagcatgggtttatatgctgggtataccatccatgacttgaccaaacacataatatctattgcttatcgactacattgtgttaggtgctataaaacagttacattaaactttttcatttaaatattgcaatatccctgtaacataggtaatttgtcttcattttacagatgagaaaactcagatttagggaagtaaagcaacgtgtttatggtcacaccaatagtccatggcagagtaggattcatactctgaagctctaagtgaaaactgtcgttattgtatttcattgcatatgaatatctaggatgtgcatagacctggaagcattacaagagacctggagtaggccaagagccatcaacatggttctagaaaaccctgtgactatctgagaaaacatgtttctagcatattcctcagatatgttaacttgcgctaaaccctgcagatgactcattcttttcagtactgtcccagactccagtatcatagccaggatggtttgagtttttgggtagaattcaacccgtcagataaaacagatatggatgaaacatgaagacagcaactcctcataaaatagtgttataaacaacacttaatcatttatatatctacttctttattattatgtatatttaaggtatacagcatcaggtttgatatacatatacaaataaaataactactgcaggtaagtaaatgaacctattcatccccttcaatagctacctttttattttcctggtaagagtacctacaatctacacatttatcacattttcaatatagaataaaatattatttactatagtcttcttgcagtgcattagacctttagaattattcatcttatgttactgctaagttctaccctttgacctaggtctctccattttcttcacctcccagccactggaaaccacctttctattctcagtttctaagtattcaactttcctttttagattccacatatatatgagagcatacagtatctttctgtttctggtttatttcacttagcataatgttctcctggttcgtccatcttagtgcaagtaaaagattctccttttttaaggctgaataatattgtattgtatatgtgtgcatgtgtatgtttgtgtatatacatatatgtcacaatttttaaatccatttatttattaatggacacaggttgtttccatatcttgggaactgtgaataatgctgcaatatacatgggagtacatatatctctattaaggtcctgatttcatttcctttggatatatacccagcagagggactactgcgtcatatttaaccaaggaagtgaaagatctgtacactgaaatctataaaacattgaaggaaattgaagaaaacacaaataaatggaaagatatttcatgctcatggattggaagaatgagtattgttaaaatgtctattctactcaaagcaatatactgaatcaactcaattcctaaaacaacccaatggcatttttcacagaaattaaaaaataattctaaaattcatatagaaaagcaaaagaccctgaatagctaaagcaatattaagaaaagaaaacacaggtggggcattacacgtcctgatttcaaattatattacaaagctatattaatcaaaacagttactggcaaaaagacaaatagatcaatggaactaaatagagagcctggaaataaacccaagcatatatgatccactaattttcaagaaagtcattaaagtgacacaatggggaaagaatagtctcttcaataagtgatttttcctgaaaaaaatggggtagttatatgcaaaataatgaaatagaacccttatcttacaccataaacaaaaaccaactcaaaatgaattaagaacttaaacataagacctgaaataataaaatacagaagaaaatagggagaaaggttcttgatgttggtcttggtaattatttttttggatattacatcaaaatctcaggcaacagtaggaaaagtaaacaagtgggactatgtcagactaagaaacttctgcacagcaaaggaaacaaccaataaaatgaaaaggcagtctatggattgagagcaaatcctttttacccatatatctgataaggatttagcatccaaaatatgtaaattactcacagaaataaatagtaataaaaacaaatactccaatttaaaaatgagcctgaatagatatttttcccaaaaagacacaaatatggccaacacgtatatgaaagggtgctccacatcactaatcatcagaggaatgcaaatcaaaaccaaaactaggtaccatttcatacctgttaggatgaatattataaagacaacaggtaacaagtgttgctgaggagtacagaagaagttaacccttatacactgctggtggaaatacaacttggtgcaaccattatgaaaaacactatggaggttactcaaaaaatgaaatcatatttttaaacaccttattttgacctgggtccatttcttatcatgtggctttgtagactacagctaatagttccttaaataaatgtactacatatatttggcgatggtcaggaaccacatagctattttaattagatatgtgcttgatgaaaaatcactttggaattttctagtggtaggaagaggtaaaattacatatgtgtatagtatatacatatgctggctgggaatctcccagcctttggagccgtggttaaacttaatgtgacttgacatttcacaatcttgtagcagtccagagttctaccttgtaaattctgtgaattctaggaaatcatttctatttttctctgtcttggtgctctcgcatcaataagcatttgctgcctctattccaccacaaatcaatctgggtgtagattccagccttgtcaccaattctcttaaataaattaatttaataatttcatagaaggatttttttttttttgccctgggcaaagtggttttggatatgattatatcacatagcttacagtcttccccatttcactaattcaatcctcagtttcatttctattttccactttgaattattgcagaaacaagaaaattcttcccctcttataccaaaaactacggggtcctactttctaccacacacttagattgggatctccctttccactacacttgcttacataaatatattcctttcctaaaaggaattcagttgactaagatgctctccatttaatgagattctcatgttatattttcctacttatatcttttatatatttttttctctctattattaaatgcttatcaatgaaacctctggactttcaaacataatatacatttatgagagttttgtttgtattattgttatattagcctaaatgaatacttttcaataaattaatttattaaaaattatttaattcattgaaattattcatttaggcgaacataatagtaatacaaataaaaatttacatgtctaaaacagataatattatgaaaatatatccagtaattgagaattttttctccttagatttaggcctctgacttccttgaccaaaataatgtaggggaaaaatgacagcatgccaaaagcttgattttttataaataactgaaggctcttgtacccatgtctaatctcattataaacatggatgctcaaatacttgtgaacagtgaagagacacatcctgagccagatttaggcttcagtgaaatttattaaatacaccctaatgtttgaaagtagcgttggtttactttttaagggcttgaattaaccaaaagttgtcttgaatttttctgttacagaaccaaatccagtaaataaggtagatttagtaagtaatatggttttcatacaatgtcatttgatcttgagtaatcagcaaaaagaaaaatatagtttcctatttggcatttttagttgtaatattttttgctatttatattgcttataatgctaatttagaaattttttaaaaatatcaagtaatacattctcattgtaaaatgagaactaagaattctccagtgagaactgaggataactcttctcactaaggagaatggggattttaccctttccccatcttctccaaacagaatctccataaataacaggtgttaaaaatctggtgtagattcttctagttatttttccatatgtgcatatataaaaacgaaacctgggaaaatacaattcatatcttggactttattaagcatataccttgaatgttgttttatttatcaaattttattgggtctaaataccataatttacatatttattttcatattgaacgacgtttcagttgtctgaaatgtgttggtgattttcagtgtacctgctacaaggcatatcatggtacaaacgcctttgtgtacatatatgcaagaatttccatatgactgaatcctaggaacaagtttgctgtgtcaaaaataatggccatttaaaaatttggttgctaccacataattgtgtttaaaaaaaaaaaaaaagaggagaaagtgaaatttacaatttagaattgaatttgccaatttagagggtttttgtttacctgtgcctcagggacctatatggtgatttgaggtactacacactctgattttgtgtcttttaaaaattttgatgttttatcattggatcttatgcaataatttttatttttacattttttattacaatgtaattgatcttgattattaaggtattacattgattattatatattatatttattattcgtgtttcttagttttatttgcttttgagttttataataatattgataacattctatgtagtcttctatgagtaacttcatatttttcaatacaaatacgaatacactaatacaattaatccattttattgctatagcatttcattgtgtgaataatataccacaaattattttttcattcttaatgcctagcaagcagtttttccccaggttttttgctattattgacaaggcttctaattattaatgtgcatgtgccttttgaagatatgtagctaagtagacaatttctgagttatagggcaaatgtgcaagaaaattcaaatttttaagataaattattttccaatgtgactgcacaataataaacataaagtcataaaaaccctagaagaaaacctaggcaataccattcaggacataggcatgggcaaggacttcatgtctaaaacaccaaaagcaatggcaacaaaagccaaaattgacaaatgggatctaattaaactaaagagcttctgcacagcagagtgaacagacaacctacagaacgggagaaaatttttgcaatctactcatctgacaaagggctaatatccagaatctacaaagaactcaaacaaatttacaagaaaaaaaaaaacaaccccatcaaaaagtgggcgaaggatatgaacagacacttctcaaaagaagacatttatgcagccaaaagacacatgaaaaaatgctcatcatcagtggccatcagagaaatgcaaatcaaaaccacaatgagataccatctcacaccagttagaatggtgatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccgtttgacccagtgatccctttacttggtatatacccaaaggattataaatcatgttgctataaagacatatgcacatgtatgtttattgcggcattattcacaatagcaaagacttggaaccaacctaaatgtccaacaacgatagactggattaagaaaatgtggcacatatacaccatggaatactacgcagccataaaaaatgatgaattcatgtcctttgtagggacatggatgaagctggaaaccatcattctcagcaaactatcgcaaggacaaaaaaccaaacaccgcatgttctcactcataggtgggaattgaacaatgagaacacatggacacaggaaggggaacatcacacaccggggcctgttgtggggtggggggaggggggagcgatagcatttggagatatacctaatgttaaatgacgagttactgggtgcagcacaccaacatggcacatgtatacatatgtaactaacctgcacgttgtgcacatgtaccctaaaacttaaagtataataataataaaaaaaaagaaagcaattgaatgtattcttttatggttagtatatttattttgtctaagtctagctgtagcatattgcatttcccaaaaataaacacaagtcccatcccaaatactcttctgtaatgtagtctcacctctcttccatctagaggtggaatataattctcctgtcctgtaatctaggttggacttagtggctttctgagcagaagtgacattctgagacttctgtggttgggacataggatgagcttcttaaaatagctctacttcggttactgcctttcagatactagccagcaagcaggctgtgagaagcccaagctacaaagagaaaccatctgtagacattctgggagggaaatagcttcaaatgagctccccaacaataccagacagactgctatccatgtgagtgagccatcttggatgtccagctaagtcaagctttcagacaactccatcccattagctataattacataaaaggcctcaagtgaggactacccaactgtgagagataataataatttgctactttaaatcacaaattttggagcagtttgttatgtagaaaaagagtattaactgaaatacaaaaatatatttgctttatattcatcgaatagttaacattaaaaaaattatatcccattccttgatccagctgtagctgtttttttttttcacttttctttaaatatctttattttttaactgacaaaaatttgtgtatatttctcatggagctgatttttgcgtatgatgaaattacagccccaattctatatcctgataaggctaacaacacaaaaccaagttttgtccaaaactatgttttacatagtggttgttttccagatccattaacttaattttgggcttgtggcttcattgacttttaggtttgtacaaaaaagtaaaagaataactcatagcaaatttcataaaatctaatttgttatacataaaacctatgagattagtcactattagttaaataaatacattattaaggaagcagggaataaaagttaaatacaggctcattagggtcaaataaattaggtttaaatctcatgtttgcaaatttactgaactttttcatctctttaaagaaagcagttaaactcgtaattcagcattttcatgataataaaataaaataatcatttaagatttcttagcattagaaactggcataaattaaattatcagcaagtggcacctctcttgacccacaaaagacagaacagaaactttctgtaatatgtggagaaatatgtgggatttgaatctatagagcttaccatctctgaaatggagctttgcattttcatgaaagatttagggttaaagaatatctatcttactttatgagacttaatgtgtttctaaatcatttttatacacaatatgtaggatttttcattcacttttcaattttgtaaattgccaaactaaacctgttcttctgaaaaaaaatgcttcaccataaagaacaataatcatccaagaatattgggatgcatactttgaaaagttgtttcctgcttttctatatttgcaatagtaaacagcaaacctttactttttttgacagtagtttgatttaccaatatgcctaatctgttctggtacataaggatgtttatgaaaaaaatgttttttctcaggatctcagaatctcatattctgttatagacagctttggtatgtatacttaaaggttggctgaagtatatttctttaacttcttaatgtgaaatttaagcaactacactagtttaatagacaaaattttttagcatttttaggtttgtagaaaaaattgtcaaaatagaatgtttccttcacacgtggaaactaaaaattaaaacaattgaactcatggagttagagagtagaacgctggttatcagaggctgggaagacagtggtagggaagtagggatagttaatgggtgcaaaaatataattagatagaatatataagatctagtatttgatagcacaacagtgtgactatagtcaacagtaatttattgtacattttaaaacaactaagagagtagaactgaaatgttcctaaaacaaattataaatgctcgagttaatggacatcacagttaccccaatgggatcgttacacattatatgtctgtatcaacaaatcacatgtacaacataaatatatacccataggtacccaaataatttaaaataaaaacttttttagaaagtacagagaatttacaaatcttcctcatttccccactacagtttcccctattattaacatcttggattaatgtggtacatttgttacaattaataaggcaatattgatacattataattaacgaaagcttatagtttacattaggatttactttgtgttgcacattctgtgggtttggataaatatgtaatgacatgtatcctccattatagtgttaacacagaatacttgcactgcattaaaaatcgcttgctccgcattttcatccttccttcctgacaaaccattggcaaccattgatctctttactgtctccatagttcttcctttcccagaatgtcttacagttggaactgtatactcttttcatattggcttctttcacttaaaaatatacatttaatgttctaccaactttttcatggcttattagctcatttatttttatcactgaataatatgtcattgtgtagctgtaccagtttgtctgtccacttgttgaaagacatcttggctgcttccaagtcttggcaattctgaataaagctgctataaacattcttgtgtagctctttgtgtgaacgtagatttttcatctcatttgggtaaataacaatgagtgtaaatcctggataatatggtaagaatatgtttagctttgtaagaaattgccaaacgccaacacaaagtgactgtaccattttgaattcctatcaacaatgaataagagttcttgttgctccaaatcctagccagtatttgctattgtcagtgttttggattttagccactctaatagctgtgtaatggtatatcattgttgtttcaatttacaattccctaatgacatatgatgctgaatattttttcatgtacatacttgccatctgtatatcttctttgaggaagtgtttgttcagatcttttgctcatttactaattcagttgtttgttttcttattgttattagttttttgtaaaattgggataccgggtctttatcagatatgtgtttttgcaaaaattttctccctatttttaacttgtgccttcattatcttagcagtgtattgcacagataaaaaggttttaatttttgtgaaatccatcatcagttttttccttcatagattgagcttttggcattaaatccaaaaaaatcatcaacaaacccaaatttgtctagattttcttctatattgtctatatgagttctatagtttgtgttttacatttaggtctatgatccattttcagaaaacttttataaaatgtgtaaagtctatgtttagattcctttttatgtggaagtccagatgtttcagcacatttgttgaaaagtttgtcttttccccatcaaattgccttcgctctactgttaataatcacatgactacatttgagtgaatctaattctgggctctctattcggttttatttatctatttacctgttctttagccaatactgtatcctcctggctactgtaatgtcttaaagtaaagtaatgtcaatcttctgattttgttcttgtc
